United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 16

SEQ ID NO: 17532 - DNA, 3933 bp, Homo sapiens
aaagggggcagcaggaccgggcccaccagccatccgggctgcccacgcaaaccacagggccgaatccggagccgcccaaggccacacagctaagccgagtgcgtgaatgcttatgtgaccgtgtgaaggaggttcccaccgtgtggctgtgggggatggaaaaaggctacttggaaagatgtagaagaccttcgagtaaacagttacgtttcagaaacagagcctgctcagaatgtgtacttggtgggattctattcttagggacgcttctttcttctgagagacccgagctctgtggcgagtggcacaggcagggccccttcctttcctagttgggttctgacagctccgaggcagtggtttacacaaccaacacgaaacatttctacgatccacccgattcctcccctcattgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtg

SEQ ID NO: 17533 - DNA, 3601 bp, Homo sapiens
gtaagtgctcagacattaagccgttgagtagaggcatgttttgcaatctctcgtttagctaccaattggagcagtttaacgtgcttgagtccccggcgtgatgtgttcatggacgaagttgccgatggatgttgtcaggtgttgcacctggagggcccagatggatcaatgaggcatttaaagtgtagaatctcaccctgaacccagactattcagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtg

SEQ ID NO: 17534 - DNA, 1594 bp, Homo sapiens
tttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggtgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggctt

SEQ ID NO: 17535 - DNA, 758 bp, Homo sapiens
agtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggtgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtccc

SEQ ID NO: 17536 - DNA, 1287 bp, Homo sapiens
gcgtgatgtgttcatggacgaagttgccgatggatgttgtcaggtgttgcacctggagggcccagatggatcaatgaggcatttaaagtgtagaatctcaccctgaacccagactattcagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctctatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgca

SEQ ID NO: 17537 - DNA, 1336 bp, Homo sapiens
gaatacttcttgctggaagtccctcacccagagaccagtgctcccaacggcagagcagcgggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactgg

SEQ ID NO: 17538 - DNA, 1656 bp, Homo sapiens
agagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctc

SEQ ID NO: 17539 - DNA, 507 bp, Homo sapiens
gatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttgg

SEQ ID NO: 17540 - DNA, 625 bp, Homo sapiens
cctgctcgcggatcccgagtagagaacgcaagcacccacgcccgcctgcaagctcccgggcgcccccggcctctcctgctcggcggaacgaggataacccagtagagccggacccagggatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttgg

SEQ ID NO: 17541 - DNA, 2023 bp, Homo sapiens
acttttggtcgagcggagggcgcgcagctccaccgttgccaagacgccgcgtaaacacccgagcgcgcgcagccaggtgcgctccttggggctgctggctgctgcgtttgcggcgggaggtggtggccgcggtcccacgagagggggtatttttcgtcagccaagatgggttccaaaaggagaaatttgagctgtagtgaaaggcatcagaaattagtagatgaaaactactgcaaaaaattacatgtccaagctctaaaaaacgtcaacagtcaaatcaggaatcaaatggtgcagaatgaaaatgataaccgtgttcagcgcaagcaatttctcagattattacaaaatgaacaatttgagttggatatggaagaggccattcaaaaggcagaagaaaacaagagattgaaagaactccagctcaaacaagaagaaaaactggctatggaattggcaaaactgaaacatgaaagtctaaaggacgaaaagatgaggcaacaagtaagagaaaacagcattgagcttagagaattggagaagaaattaaaagcagcttacatgaataaagaaagggcagctcagattgctgaaaaggatgccattaaatatgaacaaatgaaacgtgatgctgaaatagccaaaaccatgatggaagaacacaagagaataataaaggaagagaatgctgcagaagacaaacgaaacaaagcgaaagcacagtactatcttgacttagagaaacaacttgaagaacaagaaaaaaaaaagcaggaagcttatgagcagctgctaaaagagaaactcatgattgatgaaattgttaggaagatctatgaagaagatcagttggaaaaacaacaaaagttagaaaaaatgaatgcaatgcgaaggtatatagaagagtttcagaaagagcaggctctctggagaaaaaagaaacgtgaggagatggaagaagaaaacagaaaaatcatagagtttgctaacatgcagcagcaaagagaagaagatcggatggcaaaagttcaagaaaatgaggagaaaaggctacagcttcagaatgcgttgacacagaaattagaagaaatgctgcggcaacgtgaagatttggaacaagtgcgacaagaattataccaggaagaacaagctgaaatatataagagcaagctaaaagaagaagcagaaaagaaattgagaaagcaaaaagagatgaagcaagattttgaagaacaaatggccttgaaggaattagtgctacaggctgcaaaagaggaagaggagaactttagaaaaactatgctagctaaatttgctgaggatgatcgaatagaattaatgaatgctcagaaacaaagaatgaagcagctggaacacaggagggctgtggaaaaacttattgaagagcgtcgccaacaattccttgcagacaaacaacgtgaactagaagagtggcagttgcagcaaaggcggcaaggatttattaatgcaattattgaagaagaaaggctaaaacttcttaaagagcatgctacaaacttactaggctatctccctaaaggagtatttaaaaaagaggatgatattgatctgcttggtgaagagttcaggaaagtatatcaacaaaggagtgaaatttgtgaagagaaatgatatcatcaaaattgggtaaagcatagattttttgcatgttaccactagatgtcagcataacttttgttttacagttcagtggcattaggtatccattgtctgtttggattttgtaaatcatcactgaatttcataacttgtaaacaattatcagatacaaattaattttaatcaagctgttatttttgtactgataatttcaaaatccgatttctacaacactacagagcactgtttgcatccccatcctcaagacagtatatttaccttgactaatacagaactctaccccaaagtgaactgccttctgtctgtgtttacgaactttacttacttgatttagccagggaaataaatatttggaattttc

SEQ ID NO: 17542 - DNA, 3147 bp, Homo sapiens
atttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatc

SEQ ID NO: 17543 - DNA, 2659 bp, Homo sapiens
gagacatgcccgtttcaccttctaccctcgggagaatgcttctctttctctctttctttcttctttccttcttgccaaaggagcctgaatttctaaactagttgatagggacacaagttagggcaagatcattcatcccagacgagtctcgctgagaattctgtattttttacttaaagctttaattttaaaataagaaaaactcagctttatagatgcaaggccaccgaattccgggtggaaggacccagctgtattgaccttatataagctcggtgccttgccgttctcccatttgcccgcctggcctcctgaaccttctttctctcctgtttgtcatgcagtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccagggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaa

SEQ ID NO: 17544 - DNA, 2373 bp, Homo sapiens
aagccatgcatgttacctccaacctcagattttctctctgtctgagtgtctgtttgcagataacttaaaatcacccatctgcatccccactcaccctccagaaagcaaacgtggagagctcactctgcagaataaaatcaagaacaccacggttgtagctgctgtggactcggcggtctgagcagcctccccgagagccgtagttgctagtagaaattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtc

SEQ ID NO: 17545 - DNA, 3084 bp, Homo sapiens
atttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccagggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtc

SEQ ID NO: 17546 - DNA, 579 bp, Homo sapiens
acagatcatagcggaatcagaatttccagcaaggaaaatcttttcatggtgaattaagtggtggatgaagaaaaatggtgatgaaaaaagccctcttggaacagagatcatgatgacacggcatctactcgttcaggaggaaccccaggcccttccagcggtggccacacgtcacacagtggggacaacagcagtgagcaagcacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgag

SEQ ID NO: 17547 - DNA, 1499 bp, Homo sapiens
atgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaagcacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccagggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcct

SEQ ID NO: 17548 - DNA, 558 bp, Homo sapiens
ggagaagtcagctccaggaatgaagtcactgctgacattttacaaatgtggttcagagctgctgcctgctgccgtgtggtcggccggcggttctccaagtttgtttagtgatctcaaaagtaaaaaaggaaagaaattctcgagagaccacattgaggtgactatatcaaattgcggagtgaatggaaatgctaaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaat

SEQ ID NO: 17549 - DNA, 1913 bp, Homo sapiens
gttgacagtcggccccacggccatggacgtcctttccccaagttagctgagcgcctgccaccgagatcccccgagcctgggcttcgcgcggccgcctaggaggaacccgcaggaaccagccctccccaactctccgcccggcgcctttctcctccaccggatcctggatgtgcagtggaggggacgagggcttgtcgggtgggaaacttaattcaaaatggctgctggaaacgcttgggttttattcgtagcaaatgttgccaatttctccggccagatacgctaaaccgatcctcagataccgtccatggctcagggcctccgacttcagggctccaggaggaaggggagacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttg

SEQ ID NO: 17550 - DNA, 2392 bp, Homo sapiens
cggaatccacctctccgcctgtgcaacacacactttacacacgcacggggactgcaagcgggcagcatcgatcgtggctcctttaagacaaactcagacagacattttttttaaccctccttctctaatctccttccagtgcagcacttgcaaagagggagagagagggagagaaagaaagagagagagagaagagagaaactgattaggaattaggactgattcaagggaagcgagcgctagggctttgtgcatttgaatattaacatttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcaggcaagtcccccatagtgactgtattcaagtcacgcaagcgaaaaccatcctcaagccattcaccgggaggtccgctacctggtaaataaactgggagtgagtataggaacgcctggcaattaaaattaaaccagtttcgtttcataacaacactaatcaatttaacatcattataaaacgtttggagaaggtggaaaaaaaaagccaacagagaaaagtaactcttaaataatatgctcagttacaatattctttgtacacattcaatatattaatgttattttttttctgagtttgccttcccagctctttctgctactatgaccactccctggtgcatggcttggtgtggaattgctgtaaactttattacctgtcaaaagggcaaaggggtcaggattgcttgtgggactcagtaaagttcaaagacattcaatgaggtagagcttttgtgtgctttaataacccaaggcagcttacttctgaagcagcttttcatgtacagttaaaacacgggattcaggtagtggtataaatacatggttcttatttctcagaccttctcttgttaatatccatcttctggtgttcgactttttttttttttaataacagtctttttgttttgtttttaaattatgagc

SEQ ID NO: 17551 - DNA, 2321 bp, Homo sapiens
attggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattg

SEQ ID NO: 17552 - DNA, 3007 bp, Homo sapiens
accgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaacatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttt

SEQ ID NO: 17553 - DNA, 3050 bp, Homo sapiens
gcctttggctacatcggacccagatgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaatacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttg

SEQ ID NO: 17554 - DNA, 3591 bp, Homo sapiens
tcccgctccccactcccgggatgtgtctccgccgtacgacgggctatggccaccacgacttccgggttccgtcatttcgttctcccgccgccgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgagaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaagctaaaaaaggggggaggggggaggaaaaaattcaagaagcagaaacccctcgcggagttttactggaagaaaaaaacgggtctgaaagattcctcctcttcatcatcatcaaccatcattcattcactaccttgacattccgggctttgattgacagctggagtggcaaaaagccatgaaacacgacagttcggttacatgtgggctgctgacgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttg

SEQ ID NO: 17555 - DNA, 2295 bp, Homo sapiens
cccgatgcctcctctcccttcaacgcttctgctgctgctcgctgcttgatgatggcggccagtattttaaaaaatagcaaaattattcatcggcttctttccctcccgtgcctctgcgtgtgtgcgagtgtgtgtgcgtgcgtgtgtgcgtgtctgggcgcgcgtgttccagcgctgtgcgagcgggcgggcggcgagtgcgtgtgagtggtgtgtgtgtgtgcgtgtgcaatcgttacacgctttcgcctcgctccagcttttaccccagcagcgcgattcccccggttctcctgctgccgctgctgcgccgctgccgccgtggctcgcgcggctcggggcgggcacgggctgcgtaggagccgccgccggggccgccgctggggccgcgctgccgcagccgctgcgccgccgcctagactactagcctgggctgcttgttttgtctctgaaattgacaaggacgcagggaatccgctgctaaataatgtttctgtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttag

SEQ ID NO: 17556 - DNA, 2738 bp, Homo sapiens
catctttatcccttcctctcttttctgttcgccctcttctccctgctctttttccctttccacccccctcctctgttctccctcacctcctgcgccccctcccccttcccgggttctgacagtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttga

SEQ ID NO: 17557 - DNA, 2917 bp, Homo sapiens
ggctcggcgcggcgcgctcctcctcgctcccgctccccactcccgggatgtgtctccgccgtacgacgggctatggccaccacgacttccgggttccgtcatttcgttctcccgccgccgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgagaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaagctaaaaaaggggggaggggggaggaaaaaattcaagaagcagaaacccctcgcggagttttactggaagaaaaaaacgggtctgaaagattcctcctcttcatcatcatcaaccatcattcattcactaccttgacattccgggctttgattgacagctggagtggcaaaaagccatgaaacacgacagttcggttacatgtgggctgctgacgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagtttt

SEQ ID NO: 17558 - DNA, 3687 bp, Homo sapiens
tcccgctccccactcccgggatgtgtctccgccgtacgacgggctatggccaccacgacttccgggttccgtcatttcgttctcccgccgccgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgagaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaagctaaaaaaggggggaggggggaggaaaaaattcaagaagcagaaacccctcgcggagttttactggaagaaaaaaacgggtctgaaagattcctcctcttcatcatcatcaaccatcattcattcactaccttgacattccgggctttgattgacagctggagtggcaaaaagccatgaaacacgacagttcggttacatgtgggctgctgacgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttg

SEQ ID NO: 17559 - DNA, 1238 bp, Homo sapiens
cccgatgcctcctctcccttcaacgcttctgctgctgctcgctgcttgatgatggcggccagtattttaaaaaatagcaaaattattcatcggcttctttccctcccgtgcctctgcgtgtgtgcgagtgtgtgtgcgtgcgtgtgtgcgtgtctgggcgcgcgtgttccagcgctgtgcgagcgggcgggcggcgagtgcgtgtgagtggtgtgtgtgtgtgcgtgtgcaatcgttacacgctttcgcctcgctccagcttttaccccagcagcgcgattcccccggttctcctgctgccgctgctgcgccgctgccgccgtggctcgcgcggctcggggcgggcacgggctgcgtaggagccgccgccggggccgccgctggggccgcgctgccgcagccgctgcgccgccgcctagactactagcctgggctgcttgttttgtctctgaaattgacaaggacgcagggaatccgctgctaaataatgtttctgtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaag

SEQ ID NO: 17560 - DNA, 854 bp, Homo sapiens
tgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaatacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtaagcaggaaa

SEQ ID NO: 17561 - DNA, 2538 bp, Homo sapiens
cttttctgttcgccctcttctccctgctctttttccctttccacccccctcctctgttctccctcacctcctgcgccccctcccccttcccgggttctgacagtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattg

SEQ ID NO: 17562 - DNA, 1442 bp, Homo sapiens
aggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaacc

SEQ ID NO: 17563 - DNA, 4818 bp, Homo sapiens
cgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttttgttaggcttttgcgtttttaatggttttaggacaagactgcacaatgccaactctatacagtgttaaaagtaggtttttccccccagcagttgagtatattttaaactcatcaataatttttaaggtaatcatctatagcctttcaatgtctatttgacctataagttccaccagcagaaaacttctaaaggtacgaaactatgtgtacatgatgagccaggttgaaagatccccttgaacatgctcaacctcctttttagatgcatgacgttaaaaaatatatactttcagataaagcttttcatgggcatcctctgccagaataaaggacttttcagggttaattttacaacataagaaataatgtctgtgctcaaaggtaatttatctgcctgtgtttttcctctgcctgtcttactacaatattgttggatatgtaaatgaaaatttacatatgggtgttcatagataagtaaacaacttctatggagtttgaaattctgactttaaaagattacttaatcattaatattttataaattatattgtggtatatttttatttcagacacatccatgtgcagggatgctagtgtgatgatttgataactaaacttaaacttttttctgaaaacaaaacaaaacaaaatggacggtataatgccattttcaaaattttatgcaacattcctggaaatctataccattagcttattgatactgcacaaacaatgtctgctaaagtgtgcaaaaagggtgaggcatgtcccctcaattttcaaataaatatactatcctggaattttttaactcttaaattttgaatctttgtttagaaagaataatgtcatatactttggctagatatgtgatgtcaaccggctaaggaaattattcatcatctctgcaaacttaaacttggaagaaatccatagttattatttggggctcttccatctttccatttcagacagcatttatggaggttctatataaatgaacgaggaaatacacttctattgttttgtgttatatttagtcaggtagaatttttacaaatacatttcagtttaagtgttgtgttgctgtttaaacatagaaataatgcttctgacacaaactaacttaatagagaaattcagtgccacttgggaaagagagatagcttccctctcatttttgctattctattttacatgaagtctttttgtaaattttaaatatttgcctatttttactttaaatacttttatgtaaactatgaaaattccccattataaatcaactctcacatcaggtgggaaaaagaacctttttttctttccactcagtaaattctgaagggtttccttggcaattggctcgtgtttaggatgtgttttatgcaattatcaagttatctcattgaagtttagagaccagagctctcaactcttggttttaatgaataaagtcatctcatgcttagtttattcgtcaaacccacgtcctatcatgttaactttaaccttcttaaatatttggagatgaatgataattgtaatatttgtttgcattaccttgctctcccccacccccaaccccatgataacacagagaagtgatagatttgtccaatttttataatgctttttttacaccaccccggaaggcacttgctcctatctcgggtttactatttagtgtaaagagttccgatttgggtatatttaagaaagactcagctgtcaaaagcaaagaaactgggaatggtgttttgacaaccatatagtgttaaaggaaatactgtagtctgaataaaattgcttatgttctcc

SEQ ID NO: 17564 - DNA, 4818 bp, Homo sapiens; identical to SEQ ID NO: 17563

SEQ ID NO: 17565 - DNA, 1000 bp, Homo sapiens
ctctcattaaggaaggtaagagcgttgccttctcgccataatcatagtcctcttctcccagaataggatttgggaaattctggctaagtcctctgcctaccctcattgccccgctgatgtgtgacatcaacagaatttctccgcaacgtttgtcagtctccaacctcagagggctcacaaagcctcctcctgaatcctctctcagtcctccaacactaccaagaagaaaagcaattattcaggatggcatcttgctggggagaagcagcctccctgaggtagatgtgttctcctgtcacttaaagaaccacttctcctggtctgagtagtaagaggcgcatttgctgttgctgcaccatttgccaaggctctgagtttgaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatact

SEQ ID NO: 17566 - DNA, 791 bp, Homo sapiens
cagcagacagaggactctcattaaggaagaatttctccgcaacgtttgtcagtctccaacctcagagggctcacaaagcctcctcctgaatcctctctcagtcctccaacactaccaagaagaaaagcaattattcaggatggcatcttgctggggagaagcagcctccctgaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgata

SEQ ID NO: 17567 - DNA, 2415 bp, Homo sapiens
ccgtcagaaatctaaacccgtgactatcatgggactcaaaaccaggaaaaaaaataagtcaaaacgattaagagccagagaagcagtcttcatacacgcggccagccagcagacagaggactctcattaaggaaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctggatcctatatcttaggtaagacatataacgcagtctaattacatttcacttcaaggctcaatgctattctaactaatgacaagtattttctactaaaccagaaattggtagaaggatttaaataagtaaaagctactatgtactgccttagtgctgatgcctgtgtactgccttaaatgtacctatggcaatttagctctcttgggttcccaaatccctctcacaagaatgtgcagaagaaatcataaaggatcagagattctggaatggtgtcattatttgcatagcaacattgcaatttgttttcctttggctacatcaacgtatcacctacactattatttatctaatatttctctttcaggcagctcatttaaactttttttggctttaattcctattgccatcctgagtggaaaaccagtatcattttccatagtagaggataactataacaacgaagataatgaaagtaatttttttaacctaagaaaatactaatggtcacagaaggctatgaacctgagacctgctctctttgtcaaacagagattaacaaggatcagagaaaagttaaaggctgtctttgacataactggaaggcttacaagagttttaaagaaattactttctcactatatgattcattgctatttaacggtgagtcagtaaaccacctaaaaatcatcttgtctcatcagaaacactagtgtaacataactgcatcattttctactaaagacaaaatttcaccaaaggggaaaaagaaaacacaggataaagagatgtattacacacatcgaaaaaaacaacatttaacaaaatattaaaatatttccccactcttctgatactgtcaagtcttactacttaaaataaggcttccacctctcccacttcaaacaaataaatgaattctaaaccaaagaaacttcatcaggcatttgggtacctcctcccctcaccacgaggtctctgctgaacctcaatcctgtacactgaggaacctgtggcttgaaccctacatccctccagaacccccagactg

SEQ ID NO: 17568 - DNA, 2851 bp, Homo sapiens
cagatatttgtctcaaagagtcccaggccaaacctcagggacctcagagcgtttagaaaaataacacctctgtgagcttggtccaggcagatcccatgcagagaggagtttgtccccttccagtccccgaggtcctggctattgccagcatggagtgacctgtgtcacctctgagtgccaggcaagggttcagcagctgacgactcagcttctgcaggatgctggcagcatagccagcgagatagttggaagccgtcagggcacagggaaggggccgagggtgccctgagtgtgcatggggggcagccctgctgcagtccaagcctttgattcccaagctatgtgcacagtttcctctggactctgccatgtggcccagccacccatacctggaataggggctaagccaagctgctctctcctccaaagggaggcagcctgtgtgctttgtccgtttgcctttgcagagacctcgatcttcacgcaaggcaagcagcagcccctgtaagcacacgagacaatcccaagtgtcagtgggaaggagatccctttcctgatggggctgcctgtgtccagtccctcccagcttccccagggccctggggctctgcaggcattcagaagtggaagccagccacagcctgggactgaagaggttaatgtgcatctgcctccgaatgttaatgtgtctaggtgatgtcagtgggagccatgaagaagggagtggggagggcagttgggcttggaggcggcagcggctgccaggctacggaggaagacccccttcccaactgcggggcttgcgctccgggacaaggtggcaggcgctggaggctgccgcagcctgcgtgggtggaggggagctcagctcggttgtgggagcaggcgaccggcactggctggatggacctggaagcctcgctgctgcccactggtcccaacgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctgatacttcccctgccaccctgcacacctccaagtcagggcaccacaacacgccaccgggagagatgctgagaaaaacccaagaccgctcgggaaatgcaggaaggccgggttgtgaggggttgttgcaatgaaataaatacattccatggggctcacacgttgctggggaggcctggagtcaggtttggggttttcagatatcagaaatccccttgggggagcaggatgagacctttggatagaacagaagctgagcaagagaacatgttggtttggataaccggttgcactatatctgtgagctctcaaatgtcttcttcccaaggcaagaggtggaagggtactgactgggtttgtttaaagtcaggcagggctggagtgagcagccagggccatgttgcacaaggcctgagagacgggaaagggcccgatcgctctttcccgcctctcactggtgcgatggaaggtggcctttctcccaagctggtggataatgaaaaataaagcatcccatctctcggcgttccagcatcctgtcaatttcccttttgctctagaggatgcatgtttatttgaggggatgtggcactgagcccacaggagtaaaagcccagtttgctaggaggtctgcttactgaaaacaaggagacctggggtgggtgtggttgggggtcttaaaactaataaaagctggggtcggggggcttttgcagctctggtgacattctctccacggggcacatttgctcagtcactaatccagcttgagtgtccgtgtgttctgcatgtgcaggggtcattctagtgcccggtgtgttggcatcatctttttgctctagcccttcctctccaaaataaaatcaaataaaggaaaatctccacccaca

SEQ ID NO: 17569 - DNA, 1219 bp, Homo sapiens
ccaagtgtcagtgggaaggagatccctttcctgatggggctgcctgtgtccagtccctcccagcttccccagggccctggggctctgcaggcattcagaagtggaagccagccacagcctgggactgaagaggttaatgtgcatctgcctccgaatgttaatgtgtctaggtgatgtcagtgggagccatgaagaagggagtggggagggcagttgggcttggaggcggcagcggctgccaggctacggaggaagacccccttcccaactgcggggcttgcgctccgggacaaggtggcaggcgctggaggctgccgcagcctgcgtgggtggaggggagctcagctcggttgtgggagcaggcgaccggcactggctggatggacctggaagcctcgctgctgcccactggtcccaacgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcgtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctgatacttcccctgccaccctgcacacctccaagtcagggcaccacaacacgccaccgggagagatgctgagaaaaacccaagaccgctcgggaaatgcaggaaggccgggttgtgaggggttgttgcaatgaaataaatacattccatggggctcac

SEQ ID NO: 17570 - DNA, 2368 bp, Homo sapiens
agaaaagagcacgacgcacccgatgctcggattggatgaagtggcaaaggtaaccccgctggttcgggcgtttggctgttcctgtgcctggacccccgctttggaaatggaggtggggctggctcccaacctgtctcagagaccctcgcactcctcccccaccttccgtcagctgggacccgctgagagccgtttttggtcacgcgcgcttagcggatagacctgcagtcccgcagagaggaagggcgcccgggctgtccgccgcgcggggaggacgcgagcacccagctttaatccctggaaagtccacgaacaatgaatccatttcatgcatcttgttggaacacctctgccgaacttttaaacaaatcctggaataaagagtttgcttatcaaactgccagtgtggtagatacagtcatcctcccttccatgattgggattatctgttcaacagggctggttggcaacatcctcattgtattcactataataagatccaggaaaaaaacagtccctgacatctatatctgcaacctggctgtggctgatttggtccacatagttggaatgccttttcttattcaccaatgggcccgagggggagagtgggtgtttggggggcctctctgcaccatcatcacatccctggatacttgtaaccaatttgcctgtagtgccatcatgactgtaatgagtgtggacaggtactttgccctcgtccaaccatttcgactgacacgttggagaacaaggtacaagaccatccggatcaatttgggcctttgggcagcttcctttatcctggcattgcctgtctgggtctactcgaaggtcatcaaatttaaagacggtgttgagagttgtgcttttgatttgacatcccctgacgatgtactctggtatacactttatttgacgataacaactttttttttccctctacccttgattttggtgtgctatattttaattttatgctatacttgggagatgtatcaacagaataaggatgccagatgctgcaatcccagtgtaccaaaacagagagtgatgaagttgacaaagatggtgctggtgctggtggtagtctttatcctgagtgctgccccttatcatgtgatacaactggtgaacttacagatggaacagcccacactggccttctatgtgggttattacctctccatctgtctcagctatgccagcagcagcattaacccttttctctacatcctgctgagtggaaatttccagaaacgtctgcctcaaatccaaagaagagcgactgagaaggaaatcaacaatatgggaaacactctgaaatcacacttttaggaaagtacatggatcaccatgagtctagacatgattgtctatcttactggtattatcagaaagggcaggtgtaccgatatgtttatgcccattcttcttgtgtacttgtgactcttagcagcatggaagagaagtgtaaccatgcaaatacaatgagcttaatatgctaactttagcaagatgtaaaatgttgatctatattgtgggtagggaatgggatagtctgagatacccaggcttcatgatggtgtatattatttcagcatattataaactagtcactaatgaaaatggccatccatgaccattgactcaaaactcaccaaggaacctgaccttgccctccacactgtggcctcactgtaacagtttcctcaaggttcctaggagggtatcaccttagagtgaagtctaaaatttggctattttttatctataaaaaatgtcagttttatatggtccaatactaataccctcaacaactaagccccaccttttagaataagttaccatttattgcacacatgcaatgtgtaagattacatgtaacaaacctgtgaaataagtattattacctttgtttgctaaggctcagaaaggagaaatgataggcctaatgctgcaacagctatctaagagctgagctaacattcagctctgcctgtttcttttctactgcacgaccttgacaacctttacttatcatactggagaacccagtaacttggagtttcttttgctttctcctgtagccctacaagaggagaactaaagtctgatagaaatgagttgatgttttaagcatcattttggattatctttgttctcacacctgctaactgtagaaactggcatctgcactttaataataatactttacttctggactttaagcataattaggaaacattcctggccgggtgcagtggctcatgcctgtaatcccagcactttgggaggtggaggcaggtggatcacaaagtcagaagttcaagaccagtctggccaacatagtgagaccctgtctact

SEQ ID NO: 17571 - DNA, 1253 bp, Homo sapiens
cgcccgggctgtccgccgcgcggggaggacgcgagcacccagatgaatccatttcatgcatcttgttggaacacctctgccgaacttttaaacaaatcctggaataaagagtttgcttatcaaactgccagtgtggtagatacagtcatcctcccttccatgattgggattatctgttcaacagggctggttggcaacatcctcattgtattcactataataagatccaggaaaaaaacagtccctgacatctatatctgcaacctggctgtggctgatttggtccacatagttggaatgccttttcttattcaccaatgggcccgagggggagagtgggtgtttggggggcctctctgcaccatcatcacatccctggatacttgtaaccaatttgcctgtagtgccatcatgactgtaatgagtgtggacaggtactttgccctcgtccaaccatttcgactgacacgttggagaacaaggtacaagaccatccggatcaatttgggcctttgggcagcttcctttatcctggcattgcctgtctgggtctactcgaaggtcatcaaatttaaagacggtgttgagagttgtgcttttgatttgacatcccctgacgatgtactctggtatacactttatttgacgataacaactttttttttccctctacccttgattttggtgtgctatattttaattttatgctatacttgggagatgtatcaacagaataaggatgccagatgctgcaatcccagtgtaccaaaacagagagtgatgaagttgacaaagatggtgctggtgctggtggtagtctttatcctgagtgctgccccttatcatgtgatacaactggtgaacttacagatggaacagcccacactggccttctatgtgggttattacctctccatctgtctcagctatgccagcagcagcattaacccttttctctacatcctgctgagtggaaatttccagaaacgtctgcctcaaatccaaagaagagcgactgagaaggaaatcaacaatatgggaaacactctgaaatcacacttttaggaaagtacatggatcaccatgagtctagacatgattgtctatcttactggtattatcagaaagggcaggtgtaccgatatgtttatgcccattcttcttgtgtacttgtgactcttagcagcatggaagagaagtgtaaccatgcaaatacaatgagcttaatatgctaactttagcaagatgtaaaa

SEQ ID NO: 17572 - DNA, 2144 bp, Homo sapiens
gcaccccacgctcctagaaaagagcacgacgcacccgatgctcggattggatgaagtggcaaagctttaatccctggaaagtccacgaacaatgaatccatttcatgcatcttgttggaacacctctgccgaacttttaaacaaatcctggaataaagagtttgcttatcaaactgccagtgtggtagatacagtcatcctcccttccatgattgggattatctgttcaacagggctggttggcaacatcctcattgtattcactataataagatccaggaaaaaaacagtccctgacatctatatctgcaacctggctgtggctgatttggtccacatagttggaatgccttttcttattcaccaatgggcccgagggggagagtgggtgtttggggggcctctctgcaccatcatcacatccctggatacttgtaaccaatttgcctgtagtgccatcatgactgtaatgagtgtggacaggtactttgccctcgtccaaccatttcgactgacacgttggagaacaaggtacaagaccatccggatcaatttgggcctttgggcagcttcctttatcctggcattgcctgtctgggtctactcgaaggtcatcaaatttaaagacggtgttgagagttgtgcttttgatttgacatcccctgacgatgtactctggtatacactttatttgacgataacaactttttttttccctctacccttgattttggtgtgctatattttaattttatgctatacttgggagatgtatcaacagaataaggatgccagatgctgcaatcccagtgtaccaaaacagagagtgatgaagttgacaaagatggtgctggtgctggtggtagtctttatcctgagtgctgccccttatcatgtgatacaactggtgaacttacagatggaacagcccacactggccttctatgtgggttattacctctccatctgtctcagctatgccagcagcagcattaacccttttctctacatcctgctgagtggaaatttccagaaacgtctgcctcaaatccaaagaagagcgactgagaaggaaatcaacaatatgggaaacactctgaaatcacacttttaggaaagtacatggatcaccatgagtctagacatgattgtctatcttactggtattatcagaaagggcaggtgtaccgatatgtttatgcccattcttcttgtgtacttgtgactcttagcagcatggaagagaagtgtaaccatgcaaatacaatgagcttaatatgctaactttagcaagatgtaaaatgttgatctatattgtgggtagggaatgggatagtctgagatacccaggcttcatgatggtgtatattatttcagcatattataaactagtcactaatgaaaatggccatccatgaccattgactcaaaactcaccaaggaacctgaccttgccctccacactgtggcctcactgtaacagtttcctcaaggttcctaggagggtatcaccttagagtgaagtctaaaatttggctattttttatctataaaaaatgtcagttttatatggtccaatactaataccctcaacaactaagccccaccttttagaataagttaccatttattgcacacatgcaatgtgtaagattacatgtaacaaacctgtgaaataagtattattacctttgtttgctaaggctcagaaaggagaaatgataggcctaatgctgcaacagctatctaagagctgagctaacattcagctctgcctgtttcttttctactgcacgaccttgacaacctttacttatcatactggagaacccagtaacttggagtttcttttgctttctcctgtagccctacaagaggagaactaaagtctgatagaaatgagttgatgttttaagcatcattttggattatctttgttctcacacctgctaactgtagaaactggcatctgcactttaataataatactttacttctggactttaagcataattaggaaacattcctggccgggtgcagtggctcatgcctgtaatcccagcactttgggaggtggaggcaggtggatcacaaagtcagaagttcaagaccagtctggccaacatagtgagaccctgtctact

SEQ ID NO: 17573 - DNA, 935 bp, Homo sapiens
gacccacagacacacttggacgattcctgcagaaatcagtgaggcagtctcctcccaggggcttggcgcctggctcgaggcgaggctgccggcccggacgctgactgcccagtgccacagacatggccaacgggaccaacgcctctgccccatactacagctatgaatactacctggactatctggacctcattcccgtggacgagaagaagctgaaagcccacaaacattccatcgtgatcgcattctgggtgagcctggctgccttcgtggtgctgctcttcctcatcttgctctacatgtcctggtccgcctccccgcagatgaggaacagccccaagcaccaccaaacatgcccctggagtcacggcctcaacctccacctctgcatccagaagtgcctgccgtgccacagggaacccctggcaacctcacaggctcaggcgagctcagtggagccagggagcagaactggccctgaccagccgctacgacaggagagctcctccaccttgcccctcgggggtttccagacccaccccactctcctctgggaactgaccctcaatgggggtcccctcgtcaggagcaagcccagcgagcctccccctggagacaggacctctcaattgcagagctgatgtcagtaaatcgtggccatagctgagtgaactggtgaaatcaagccaacctggacacatacgttcctcgttcttcttagaggccatttgcatgtagcagaaagggcacctaggtcaagtgcaactagagcaggagcatcctatgcctttgacaaagattgcagtggcccctcgagtgcagaggtcatcccaggtgttgctgagtttattgagcacacctagcctgcttgcttactgcttatatttgctcagggaagagtaggaaaataaaatatatgcaaatcaagaggaaaa

SEQ ID NO: 17574 - DNA, 440 bp, Homo sapiens
atggccaacgggaccaacgcctctgccccatactacagctatgaatactacctggactatctggacctcattcccgtggacgagaagaagctgaaagcccacaaacattccatcgtgatcgcattctgggtgagcctggctgccttcgtggtgctgctcttcctcatcttgctctacatgtcctggtccgcctccccgcagatgagctttaacacagatgaatctcttctgcattcagaagtgctgcctcaaactcgagctatttcctgtgatgagctccaagcccctagagaggaaggggcggcctgacgaggcactggatgggcctcatggcctagaagtccccacattccttgcaactctgatgctgggcacctacaggcccgagtttatcatttactgggcagttcaataaagtcctctcaacttttcttgtcaaa

SEQ ID NO: 17575 - DNA, 1000 bp, Homo sapiens
ggataatggggaggctatgcaggtgtgtgggctggagggactttgcagatgtgattaaggattgtgagatggaaaaattatccttgattacctgcacggacccagtataatcacaactgtccttataagaagaggagctttggaagaagagagagttgactacggaagagggaaaagtgccacagacatggccaacgggaccaacgcctctgccccatactacagctatgaatactacctggactatctggacctcattcccgtggacgagaagaagctgaaagcccacaaacattccatcgtgatcgcattctgggtgagcctggctgccttcgtggtgctgctcttcctcatcttgctctacatgtcctggtccgcctccccgcagatgaggaacagccccaagcaccaccaaacatgcccctggagtcacggcctcaacctccacctctgcatccagaagtgcctgccgtgccacagggaacccctggcaacctcacaggctcaggcgagctcagtggagccagggagcagaactggccctgaccagccgctacgacaggagagctcctccaccttgcccctcgggggtttccagacccaccccactctcctctgggaactgaccctcaatgggggtcccctcgtcaggagcaagcccagcgagcctccccctggagacaggacctctcaattgcagagctgatgtcagtaaatcgtggccatagctgagtgaactggtgaaatcaagccaacctggacacatacgttcctcgttcttcttagaggccatttgcatgtagcagaaagggcacctaggtcaagtgcaactagagcaggagcatcctatgcctttgacaaagattgcagtggcccctcgagtgcagaggtcatcccaggtgttgctgagtttattgagcacacctagcctgcttgcttactgcttatatttgctcagggaagagtaggaaaataaaatatatgcaaatcaagaggaaaa

SEQ ID NO: 17576 - DNA, 624 bp, Homo sapiens
ggataatggggaggctatgcaggtgtgtgggctggagggactttgcagatgtgattaaggattgtgagatggaaaaattatccttgattacctgcacggacccagtataatcacaactgtccttataagaagaggagctttggaagaagagagagttgactacggaagagggaaaagtgccacagacatggccaacgggaccaacgcctctgccccatactacagctatgaatactacctggactatctggacctcattcccgtggacgagaagaagctgaaagcccacaaacattccatcgtgatcgcattctgggtgagcctggctgccttcgtggtgctgctcttcctcatcttgctctacatgtcctggtccgcctccccgcagatgagctttaacacagatgaatctcttctgcattcagaagtgctgcctcaaactcgagctatttcctgtgatgagctccaagcccctagagaggaaggggcggcctgacgaggcactggatgggcctcatggcctagaagtccccacattccttgcaactctgatgctgggcacctacaggcccgagtttatcatttactgggcagttcaataaagtcctctcaacttttcttgtc

SEQ ID NO: 17577 - DNA, 1591 bp, Homo sapiens
gagaagcgaggttctcgttctgagggacaggcttgagatcggctgaagagagcgggcccaggctctgtgaggaggcaagggaggtgagaaccttgctctcagagggtgactcaagtcaacacagggaacccctcttttctacagacacagtgggtcgcaggatctgacaagagtccaggagctccagggactgtgaggtgaggccttggtctaaggcagtgttttcaggtcacagagcagaaagggcccagacagtgccaggagtcaaggttctcaggggacagggagagcaagaggtcaagagctgtgggacaccacagagcagcactgaaggagaagacctgcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcaccccagaggaggtttctgctgatgatgagacaccaaatcctccccagagtgctcagatagcctgctcctccccctcggtcgttgcttcccttccattagatcaatctgatgagggctccagcagccaaaaggaggagagtccaagcaccctacaggtcctgccagacagtgagtctttacccagaagtgagatagatgaaaaggtgactgatttggtgcagtttctgctcttcaagtatcaaatgaaggagccgatcacaaaggcagaaatactggagagtgtcataagaaattatgaagaccacttccctttgttgtttagtgaagcctccgagtgcatgctgctggtctttggcattgatgtaaaggaagtggatcccactggccactcctttgtccttgtcacctccctgggcctcacctatgatgggatgctgagtgatgtccagagcatgcccaagactggcattctcatacttatcctaagcatagtcttcatagagggctactgcacccctgaggaggtcatctgggaagcactgaatatgatggggctgtatgatgggatggagcacctcatttatggggagcccaggaagctgctcacccaagattgggtgcaggaaaactacctggagtaccggcaggtgcctggcagtgatcctgcacggtatgagtttctgtggggtccaagggctcatgctgaaattaggaagatgagtctcctgaaatttttggccaaggtaaatgggagtgatccaagatccttcccactgtggtatgaggaggctttgaaagatgaggaagagagagcccaggacagaattgccaccacagatgatactactgccatggccagtgcaagttctagcgctacaggtagcttctcctaccctgaataaagtaagacagattcttcactgtgttttaaaaggcaagtcaaataccacatgattttactcatatgtggaatct

SEQ ID NO: 17578 - DNA, 2631 bp, Homo sapiens
agagagaagcgaggttctcgttctgagggacaggcttgagatcggctgaagagagcgggcccaggctctgtgaggaggcaagggaggtgagaaccttgctctcagagggtgactcaagtcaacacagggaacccctcttttctacagacacagtgggtcgcaggatctgacaagagtccaggttctcaggggacagggagagcaagaggtcaagagctgtgggacaccacagagcagcactgaaggagaagacctgcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcaccccagaggaggtttctgctgatgatgagacaccaaatcctccccagagtgctcagatagcctgctcctccccctcggtcgttgcttcccttccattagatcaatctgatgagggctccagcagccaaaaggaggagagtccaagcaccctacaggtcctgccagacagtgagtctttacccagaagtgagatagatgaaaaggtgactgatttggtgcagtttctgctcttcaagtatcaaatgaaggagccgatcacaaaggcagaaatactggagagtgtcataagaaattatgaagaccacttccctttgttgtttagtgaagcctccgagtgcatgctgctggtctttggcattgatgtaaaggaagtggatcccactggccactcctttgtccttgtcacctccctgggcctcacctatgatgggatgctgagtgatgtccagagcatgcccaagactggcattctcatacttatcctaagcatagtcttcatagagggctactgcacccctgaggaggtcatctgggaagcactgaatatgatggggctgtatgatgggatggagcacctcatttatggggagcccaggaagctgctcacccaagattgggtgcaggaaaactacctggagtaccggcaggtgcctggcagtgatcctgcacggtatgagtttctgtggggtccaagggctcatgctgaaattaggaagatgagtctcctgaaatttttggccaaggtaaatgggagtgatccaagatccttcccactgtggtatgaggaggctttgaaagatgaggaagagagagcccaggacagaattgccaccacagatgatactactgccatggccagtgcaagttctagcgctacaggtagcttctcctaccctgaataaagtaagacagattcttcactgtgttttaaaaggcaagtcaaataccacatgattttactcatatgtggaatctaaaaaaaaaaaaaaaaaaagttggtatcatggaagtagagagtagagcagtagttacattacaattaaataggaggaataagttctagtgttctattgcacagtaggatgactatagttaacattaagatattgtatattacaaaacagctagaaggaaggcttttcaatattgtcaccaaaaagaaatgataaatgcatgaggtgatggatacactacctgatttgatcattatactacatatacatgaatcagaacatcaaattgtacctcataaatatctacaattacatgtcagtttttgtttatgtttttgtttttttttaatttatgaaaacaaatgagaatggaaatcaatgatgtatgtggtggagggccaggctgaggctgaggaaaatacagtgcataacatctttgtcttactgttttctttggataacctggggacttcttttcttttcttcttggtattttattttctttttcttcttcttctttttttttttttaacaaagtctcactctattgctctggcaggagtgcagtggtgcagtctcggctcactgcaacttccgcctcctgggttcaagcgattctcctgcctcagtctcctgagtagctgggattacaagtgtgcaccaccatacccggctaattttgtattttttagtagagatggggtttcaccatgttggccaggctggtctcaaactcctgacctcaggtaatctgcccgcctcagcctcccaaagtgctgggataacaggtgtgagccactgcacccagcctcttcttggtattttaaaatgttgttacttttactagaatgtttatgagcttcagaatctaaggtcacacgttcgtttctgtttatccagtttaagaaacagttttgctattttgtaaaacaaattgggaacccttccatcatatttgtaatctgtaataaaataacatggaattggaatagtaattttcttggaaatatgaaaaaaatagtaaaatagagaaaataattttaagtgttagtatttttatttctttattatttttagtttatcatcctgcaaaattaaaagttatatccctggatcttgttaagtcgaaattaaactgtaataaatgaaa

SEQ ID NO: 17579 - DNA, 898 bp, Homo sapiens
ggatcagagagaagcgaggttctcgttctgagggacaggcttgagatcggctgaagagagcgggcccaggctctgtgaggaggcaagggaggtgagaaccttgctctcagagggtgactcaagtcaacacagggaacccctcttttctacagacacagtgggtcgcaggatctgacaagagtccaggagctccagggactgtgaggtgaggccttggtctaaggcagtgttttcaggtcacagagcagaaagggcccagacagtgccaggagtcaaggttctcaggggacagggagagcaagaggtcaagagctgtgggacaccacagagcagcactgaaggagaagacctgcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcaccccagaggaggtttctgctgatgatgagacaccaaatcctccccagagtgctcagatagcctgctcctccccctcggtcgttgcttcccttccattagatcaatctgatgagggctccagcagccaaaaggaggagagtccaagcaccctacaggtcctgccagacagtgagtctttacccagaagtgagatagatgaaaaggtgactgatttggtgcagtttctgctcttcaagtatcaaatgaaggagccgatcacaaaggcagaaatact

SEQ ID NO: 17580 - DNA, 798 bp, Homo sapiens
tgaagagagcgggcccaggctctgtgaggaggcaagacacagtgggtcgcaggatctgacaagagtccaggagctccagggactgtgaggttctcaggggacagggagagcaagaggtcaagagctgtgggacaccacagagcagcactgaaggagaagacctgcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcaccccagaggaggtttctgctgatgatgagacaccaaatcctccccagagtgctcagatagcctgctcctccccctcggtcgttgcttcccttccattagatcaatctgatgagggctccagcagccaaaaggaggagagtccaagcaccctacaggtcctgccagacagtgagtctttacccagaagtgagatagatgaaaaggtgactgatttggtgcagtttctgctcttcaagtatcaaatgaaggagccgatcacaaaggcagaaatactggagagtgtcataagaaattatgaagaccacttccctttgttgtttagtgaagcctccgagtgcatgctgctggtctttggcattgat

SEQ ID NO: 17581 - DNA, 1845 bp, Homo sapiens
tgcactctcaccagggcagggagctgtcttgacccccagtggaggctgacaatttttttcctgtgtacactggacccctttcatagaggtgggtgctatgcaagtggagctggtgactgatggctgaccattgatacaggctaggaataccaatgagcaaggtgagcactatgttctcagaggacgacttccagtcaacagaaagagccccatatggtccacaactacagtggtcccaggatctgccaagagtccaggtttttagagaacaggccaacctggaggacaggagtcccaggagaacccagaggatcactggaggagaacaagtgctgtggggccccatcacccagatatttcccacagttcggcctgctgacctaaccagagtcatcatgcctcttgagcaaagaagtcagcactgcaagcctgaggaaggccttcaggcccaagaagaagacctgggcctggtgggtgcacaggctctccaagctgaggagcaggaggctgccttcttctcctctactctgaatgtgggcactctagaggagttgcctgctgctgagtcaccaagtcctccccagagtcctcaggaagagtccttctctcccactgccatggatgccatctttgggagcctatctgatgagggctctggcagccaagaaaaggaggggccaagtacctcgcctgacctgatagaccctgagtccttttcccaagatatactacatgacaagataattgatttggttcatttattgctccgcaagtatcgagtcaaggggctgatcacaaaggcagaaatgctggggagtgtcatcaaaaattatgaggactactttcctgagatatttagggaagcctctgtatgcatgcaactgctctttggcattgatgtgaaggaagtggaccccactagccactcctatgtccttgtcacctccctcaacctctcttatgatggcatacagtgtaatgagcagagcatgcccaagtctggcctcctgataatagtcctgggtgtaatcttcatggaggggaactgcatccctgaagaggttatgtgggaagtcctgagcattatgggggtgtatgctggaagggagcacttcctctttggggagcccaagaggctccttacccaaaattgggtgcaggaaaagtacctggtgtaccggcaggtgcccggcactgatcctgcatgctatgagttcctgtggggtccaagggcccacgctgagaccagcaagatgaaagttcttgagtacatagccaatgccaatgggagggatcccacttcttacccatccctgtatgaagatgctttgagagaggagggagagggagtctgagcatgagatgcaaccagggccagcgggcagggaaatgggccaatgcatgcttcagggccacacccagcagtttccctgtcctgtgtgaaatcaggcccattcttccctctgtgtttgatgagagaagtcagtgttctcagtagtagaaggcacagtgaatggaagggaacacattgtatactgcctttaggtttctcttccatcgggtgacttggagatttctttttgtttccctttggtaattttcaaatattgttcctgtaataaaagttttagttagcttcaacatctaagtgtatggatgatactgaccacacatgttgttttgcttatccatttcaagtgcaagtgtttgccattttgtaaaacattttgggaaatcttccatcttgctgtgatttgcaataggtattttcttggagaatgtaagaacttaacaataaagctgaactggtgttgtgaaacagagaaataaaaggagaaggtcatt

SEQ ID NO: 17582 - DNA, 1864 bp, Homo sapiens
gatctgagagaagcgaaagcgtctttctgaggggtgtcttgagagtggcagagggcagcgggtccaggctccatgaggaggcaagccttgggaatctgagggatggagactcagttccgcagagggggtctggggtgcagccctgccagcatcaagaggaagaagaagagggaggactcaggagactttggactccaggtgagcactatgttctcagaggacgacttccagtcaacagaaagagccccatatggtccacaactacagtggtcccaggatctgccaagagtccaggtttttagagaacaggccaacctggaggacaggagtcccaggagaacccagaggatcactggaggagaacaagtgctgtggggccccatcacccagatatttcccacagttcggcctgctgacctaaccagagtcatcatgcctcttgagcaaagaagtcagcactgcaagcctgaggaaggccttcaggcccaagaagaagacctgggcctggtgggtgcacaggctctccaagctgaggagcaggaggctgccttcttctcctctactctgaatgtgggcactctagaggagttgcctgctgctgagtcaccaagtcctccccagagtcctcaggaagagtccttctctcccactgccatggatgccatctttgggagcctatctgatgagggctctggcagccaagaaaaggaggggccaagtacctcgcctgacctgatagaccctgagtccttttcccaagatatactacatgacaagataattgatttggttcatttattgctccgcaagtatcgagtcaaggggctgatcacaaaggcagaaatgctggggagtgtcatcaaaaattatgaggactactttcctgagatatttagggaagcctctgtatgcatgcaactgctctttggcattgatgtgaaggaagtggaccccactagccactcctatgtccttgtcacctccctcaacctctcttatgatggcatacagtgtaatgagcagagcatgcccaagtctggcctcctgataatagtcctgggtgtaatcttcatggaggggaactgcatccctgaagaggttatgtgggaagtcctgagcattatgggggtgtatgctggaagggagcacttcctctttggggagcccaagaggctccttacccaaaattgggtgcaggaaaagtacctggtgtaccggcaggtgcccggcactgatcctgcatgctatgagttcctgtggggtccaagggcccacgctgagaccagcaagatgaaagttcttgagtacatagccaatgccaatgggagggatcccacttcttacccatccctgtatgaagatgctttgagagaggagggagagggagtctgagcatgagatgcaaccagggccagcgggcagggaaatgggccaatgcatgcttcagggccacacccagcagtttccctgtcctgtgtgaaatcaggcccattcttccctctgtgtttgatgagagaagtcagtgttctcagtagtagaaggcacagtgaatggaagggaacacattgtatactgcctttaggtttctcttccatcgggtgacttggagatttctttttgtttccctttggtaattttcaaatattgttcctgtaataaaagttttagttagcttcaacatctaagtgtatggatgatactgaccacacatgttgttttgcttatccatttcaagtgcaagtgtttgccattttgtaaaacattttgggaaatcttccatcttgctgtgatttgcaataggtattttcttggagaatgtaagaacttaacaataaagctgaactggtgttgtgaaacagagaaa

SEQ ID NO: 17583 - DNA, 1664 bp, Homo sapiens
agagaacagcgagattctcgccctgagcaacggcctgacgtcggtggagggaagcaggcgcaggctccgtgaggaggcaaggttctgaggagacaggccccggagcagcactagctcctgcccacactcctacctgctgccctgaccagagtcatcatgccacttgagcagaggagtcagcactgcaagcctgaggaaggccttgaggcccaaggagaggccctgggcttggtgggtgcgcaggctcctgctactgaggagcaggagactgcctcctcctcctctactctagtggaagtcaccctgcgggaggtgcctgctgccgagtcaccaagtcctccccacagtcctcagggagcctccaccctccccactaccatcaactatactctctggagtcaatccgatgagggctccagcaacgaagaacaggaagggccaagcacctttcctgacctggagacgagcttccaagtagcactcagtaggaagatggctgagttggttcattttctgctcctcaagtatcgagccagggagccattcacaaaggcagaaatgctggggagtgtcatcagaaatttccaggacttctttcctgtgatcttcagcaaagcctccgagtacttgcagctggtctttggcatcgaggtggtggaagtggtccgcatcggccacttgtacatccttgtcacctgcctgggcctctcctacgatggcctgctgggcgacaatcagatcgtgcccaagacaggcctcctgataatcgtcctggccataatcgcaaaagagggcgactgtgcccctgaggagaaaatctgggaggagctgagtgtgttggaggcatctgatgggagggaggacagtgtctttgcgcatcccaggaagctgctcacccaagatttggtgcaggaaaactacctggagtaccggcaggtccccggcagtgatcctgcatgctacgagttcctgtggggtccaagggccctcgttgaaaccagctatgtgaaagtcctgcaccatttgctaaagatcagtggaggacctcacatttcctacccacccctgcatgaatgggcttttagagagggggaagagtgagtctgagcacgagttgcagccagggccagtgggagggggtctgggccagtgcaccttccaaggccccatccattagtttccactgcctcgtgtgatatgaggcccattcttcactctttgaagagagcagtcagtattgttagtagtgagtttctgttctattggatgactttgagatttatctttgtttcctgttggaattgttcaaatgttccttttaacggatggttgaatgaacttcagcatccaagtttatgaatgacagtagtcacacatagtgctgtttatatagtttaggagtaagagtgttgttttttattcagattgggaaatccattccattttgtgaattgtgacaaataacagcagtggaaaaagtatgtgcttagaattgtgaaagaattagcagtaaaatacatgagataaagacctcaagaagttaaaagatacttaattcttgccttatacctcactctattctgtaaatttgaaaaaaaagcatggatacctggatatccttggcttctttgagaatttaagagaaattaaatctgaataaataa

SEQ ID NO: 17584 - DNA, 1761 bp, Homo sapiens
agagaacagcgagattctcgccctgagcaacggcctgacgtcggtggagggaagcaggcgcaggctccgtgaggaggcaagatctcagggagttgaggaccttttcttcagagggtgactcaggtcaacacaggggcccccatgtagtcgacagacacagtggtcctaagatctaccaagcatccaggttctgaggagacaggccccggagcagcactagctcctgcccacactcctacctgctgccctgaccagagtcatcatgccacttgagcagaggagtcagcactgcaagcctgaggaaggccttgaggcccaaggagaggccctgggcttggtgggtgcgcaggctcctgctactgaggagcaggagactgcctcctcctcctctactctagtggaagtcaccctgcgggaggtgcctgctgccgagtcaccaagtcctccccacagtcctcagggagcctccaccctccccactaccatcaactatactctctggagtcaatccgatgagggctccagcaacgaagaacaggaagggccaagcacctttcctgacctggagacgagcttccaagtagcactcagtaggaagatggctgagttggttcattttctgctcctcaagtatcgagccagggagccattcacaaaggcagaaatgctggggagtgtcatcagaaatttccaggacttctttcctgtgatcttcagcaaagcctccgagtacttgcagctggtctttggcatcgaggtggtggaagtggtccgcatcggccacttgtacatccttgtcacctgcctgggcctctcctacgatggcctgctgggcgacaatcagatcgtgcccaagacaggcctcctgataatcgtcctggccataatcgcaaaagagggcgactgtgcccctgaggagaaaatctgggaggagctgagtgtgttggaggcatctgatgggagggaggacagtgtctttgcgcatcccaggaagctgctcacccaagatttggtgcaggaaaactacctggagtaccggcaggtccccggcagtgatcctgcatgctacgagttcctgtggggtccaagggccctcgttgaaaccagctatgtgaaagtcctgcaccatttgctaaagatcagtggaggacctcacatttcctacccacccctgcatgaatgggcttttagagagggggaagagtgagtctgagcacgagttgcagccagggccagtgggagggggtctgggccagtgcaccttccaaggccccatccattagtttccactgcctcgtgtgatatgaggcccattcttcactctttgaagagagcagtcagtattgttagtagtgagtttctgttctattggatgactttgagatttatctttgtttcctgttggaattgttcaaatgttccttttaacggatggttgaatgaacttcagcatccaagtttatgaatgacagtagtcacacatagtgctgtttatatagtttaggagtaagagtgttgttttttattcagattgggaaatccattccattttgtgaattgtgacaaataacagcagtggaaaaagtatgtgcttagaattgtgaaagaattagcagtaaaatacatgagataaagacctcaagaagttaaaagatacttaattcttgccttatacctcactctattctgtaaatttgaaaaaaaagcatggatacctggatatccttggcttctttgagaatttaagagaaattaaatctg

SEQ ID NO: 17585 - DNA, 1853 bp, Homo sapiens
aagatgccgagggaggactgaggcgggcctcaccccagacagagggcccccaataatccagcgctgcctctgctgccaggcctggaccaccctgcaggggaagacttctcaggctcagtcgccaccacctcaccccgccaccccccgccgctttaaccgcagggaactctggtatctcagggagttgaggaccttttcttcagagggtgactcaggtcaacacaggggcccccatgtagtcgacagacacagtggtcctaagatctaccaagcatccaggttctgaggagacaggccccggagcagcactagctcctgcccacactcctacctgctgccctgaccagagtcatcatgccacttgagcagaggagtcagcactgcaagcctgaggaaggccttgaggcccaaggagaggccctgggcttggtgggtgcgcaggctcctgctactgaggagcaggagactgcctcctcctcctctactctagtggaagtcaccctgcgggaggtgcctgctgccgagtcaccaagtcctccccacagtcctcagggagcctccaccctccccactaccatcaactatactctctggagtcaatccgatgagggctccagcaacgaagaacaggaagggccaagcacctttcctgacctggagacgagcttccaagtagcactcagtaggaagatggctgagttggttcattttctgctcctcaagtatcgagccagggagccattcacaaaggcagaaatgctggggagtgtcatcagaaatttccaggacttctttcctgtgatcttcagcaaagcctccgagtacttgcagctggtctttggcatcgaggtggtggaagtggtccgcatcggccacttgtacatccttgtcacctgcctgggcctctcctacgatggcctgctgggcgacaatcagatcgtgcccaagacaggcctcctgataatcgtcctggccataatcgcaaaagagggcgactgtgcccctgaggagaaaatctgggaggagctgagtgtgttggaggcatctgatgggagggaggacagtgtctttgcgcatcccaggaagctgctcacccaagatttggtgcaggaaaactacctggagtaccggcaggtccccggcagtgatcctgcatgctacgagttcctgtggggtccaagggccctcgttgaaaccagctatgtgaaagtcctgcaccatttgctaaagatcagtggaggacctcacatttcctacccacccctgcatgaatgggcttttagagagggggaagagtgagtctgagcacgagttgcagccagggccagtgggagggggtctgggccagtgcaccttccaaggccccatccattagtttccactgcctcgtgtgatatgaggcccattcttcactctttgaagagagcagtcagtattgttagtagtgagtttctgttctattggatgactttgagatttatctttgtttcctgttggaattgttcaaatgttccttttaacggatggttgaatgaacttcagcatccaagtttatgaatgacagtagtcacacatagtgctgtttatatagtttaggagtaagagtgttgttttttattcagattgggaaatccattccattttgtgaattgtgacaaataacagcagtggaaaaagtatgtgcttagaattgtgaaagaattagcagtaaaatacatgagataaagacctcaagaagttaaaagatacttaattcttgccttatacctcactctattctgtaaatttgaaaaaaaagcatggatacctggatatccttggcttctttgagaatttaagagaaattaaatctg

SEQ ID NO: 17586 - DNA, 1661 bp, Homo sapiens
agcaggcgcaggctccgtgaggaggcaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttca

SEQ ID NO: 17587 - DNA, 1965 bp, Homo sapiens
aacggcctgacgtcggcggagggaagcaggcgcaggctccgtgaggaggcaagggaactctggcgtaagagctttgtgtgaccagggcagggctggttagaagtgctcagggcccagactcagccaggaatcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 17588 - DNA, 1979 bp, Homo sapiens
aacggcctgacgtcggcggagggaagcaggcgcaggctccgtgaggaggcaaggtaagacgccgagggaggactgaggcgggcctcaccccagacagagggcccccaataatccagcgctgcctctgctgccgggcctggaccaccctgcaggggaagacttctcaggctcagtcgccaccacctcaccccgccaccccccgccgctttaaccgcagggaactctggcatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 17589 - DNA, 1981 bp, Homo sapiens
aacggcctgacgtcggcggagggaagcaggcgcaggctccgtgaggaggcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 17590 - DNA, 1724 bp, Homo sapiens
gagattctcgccctgagcaacgagcgacggcctgacgtcggcggagggaagccggcccaggctcggtgaggaggcaaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtccgagttccaagcagcactcagtaggaaggtggccgagttggttcattttctgctcctcaagtatcgagccagggagccggtcacaaaggcagaaatgctggggagtgtcgtcggaaattggcagtatttctttcctgtgatcttcagcaaagcttccagttccttgcagctggtctttggcatcgagctgatggaagtggaccccatcggccacttgtacatctttgccacctgcctgggcctctcctacgatggcctgctgggtgacaatcagatcatgcccaaggcaggcctcctgataatcgtcctggccataatcgcaagagagggcgactgtgcccctgaggagaaaatctgggaggagctgagtgtgttagaggtgtttgaggggagggaagacagtatcttgggggatcccaagaagctgctcacccaacatttcgtgcaggaaaactacctggagtaccggcaggtccccggcagtgatcctgcatgttatgaattcctgtggggtccaagggccctcgttgaaaccagctatgtgaaagtcctgcaccatatggtaaagatcagtggaggacctcacatttcctacccacccctgcatgagtgggttttgagagagggggaagagtgagtctgagcacgagttgcagccagggccagtgggagggggtctgggccagtgcaccttccggggccgcatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttactcaaattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttca

SEQ ID NO: 17591 - DNA, 2082 bp, Homo sapiens
ggaggcaaggtaagacgctgagggaggactgaggcgggcctcacctcagacagagggcctcaaataatccagtgctgcctctgctgccgggcctgggccaccccgcaggggaagacttccaggctgggtcgccactacctcaccccgccgacccccgccgctttagccacggggaactctggggacagagcttaatgtggccagggcagggctggttagaagaggtcagggcccacgctgtggcaggaatcaaggtcaggaccccgagagggaactgagggcagcctaaccaccaccctcaccaccattcccgtcccccaacaccaaccccacccccatcccccattcccatccccacccccacccctatcctggcagaatccgggctttgcccctggtatcaagtcacggaagctccgggaatggcggccaggcacgttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtccgagttccaagcagcactcagtaggaaggtggccgagttggttcattttctgctcctcaagtatcgagccagggagccggtcacaaaggcagaaatgctggggagtgtcgtcggaaattggcagtatttctttcctgtgatcttcagcaaagcttccagttccttgcagctggtctttggcatcgagctgatggaagtggaccccatcggccacttgtacatctttgccacctgcctgggcctctcctacgatggcctgctgggtgacaatcagatcatgcccaaggcaggcctcctgataatcgtcctggccataatcgcaagagagggcgactgtgcccctgaggagaaaatctgggaggagctgagtgtgttagaggtgtttgaggggagggaagacagtatcttgggggatcccaagaagctgctcacccaacatttcgtgcaggaaaactacctggagtaccggcaggtccccggcagtgatcctgcatgttatgaattcctgtggggtccaagggccctcgttgaaaccagctatgtgaaagtcctgcaccatatggtaaagatcagtggaggacctcacatttcctacccacccctgcatgagtgggttttgagagagggggaagagtgagtctgagcacgagttgcagccagggccagtgggagggggtctgggccagtgcaccttccggggccgcatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttactcaaattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttc

SEQ ID NO: 17592 - DNA, 853 bp, Homo sapiens
agcaacgagcgacggcctgacgtcggcggagggaagccggcccaggctcggtgaggaggcaagtcctgcagcctcagcatgcgctggccggatgtaccctgaggtgccctctcacttcctccttcaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtccgagttccaagcagcactcagtaggaaggtggccgagttggttcattttctgctcctcaagtatcgagccagggagccggtcacaaaggcagaaatgctggggagtgtcgtcggaaattggcagtatttctttcctgtgatcttcagcaaagcttccagttccttgcagctggtctttggcatcgagctgatggaagtggaccccatcggccacttgtacatctttgccacctgcctgggcctctcctacgatggcctgctgggtgacaatcagatcatgcccaagg

SEQ ID NO: 17593 - DNA, 1724 bp, Homo sapiens
agagacaagcgagcttctgcgtctgactcgcagcttgagactggcggagggaagcccgcccaggctctataaggagacaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaa

SEQ ID NO: 17594 - DNA, 1773 bp, Homo sapiens
agaaagcctcaggggcccggatgtgatgccactgacttgcgcattgggggttagagagaagcgagctgctgtctgaccagcagcttgggattggtggaaggaagcaggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaa

SEQ ID NO: 17595 - DNA, 1773 bp, Homo sapiens; identical to SEQ ID NO: 17594

SEQ ID NO: 17596 - DNA, 1727 bp, Homo sapiens
ggttagagagaagcgagctgctctgtctgaccagcagcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaa

SEQ ID NO: 17597 - DNA, 1773 bp, Homo sapiens; identical to SEQ ID NO: 17594

SEQ ID NO: 17598 - DNA, 1721 bp, Homo sapiens
ttagagagaagcgagctgctctgaccagccgcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaa

SEQ ID NO: 17599 - DNA, 1727 bp, Homo sapiens; identical to SEQ ID NO: 17596

SEQ ID NO: 17600 - DNA, 1029 bp, Homo sapiens
ccccaggggcccggatgtgatgccactgacttgcgcattgggggttagagagaagcgagctgctctgtctgaccagcagcttgggattggcggagggaagcgggccaggccctgtgaggagtcaaggttctgagcagacaggccaaccggaggacaggattccctggaggccacagaggagcaccaaggagaagatctgtaagtaagcctttgttagagcctctaagatttggttctcagctgaggtctctcacatgctccctctctccgtaggcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatggggg

SEQ ID NO: 17601 - DNA, 914 bp, Homo sapiens
ccccaggggcccggatgtgatgccactgacttgcgcattgggggttagagagaagcgagctgctctgtctgaccagcagcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcc

SEQ ID NO: 17602 - DNA, 986 bp, Homo sapiens
cccaggggcccggatgtgatgccactgacttgcgcattgggggttagagagaagcgagctgctctgtctgaccagcagcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatgggg

SEQ ID NO: 17603 - DNA, 854 bp, Homo sapiens
agggaagcaggcgcaggctctgtgaggaggcaaggcaggatccccggttccgcccccgctttcaaccaaggaaagccccagctgcccggatgtgatgccactgacttgcgcactgggggttagagacaagcgagcttctgcgtctgactcgcagcttgagactggcggagggaagcccgcccaggctctataaggagacaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccc

SEQ ID NO: 17604 - DNA, 997 bp, Homo sapiens
aacccaagaaagccccaggggcccggatgtgatgccactgacttgcgcattcggggttagagagaagcgagctgctctgtgaccagccgcttgggattggtggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatgggg

SEQ ID NO: 17605 - DNA, 990 bp, Homo sapiens
aagaaagtcccaggtgcccggatgtgatgccactgacttgcgcattgggggttagagagaagcgagctgctctgaccagccgcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatgggg

SEQ ID NO: 17606 - DNA, 914 bp, Homo sapiens; identical to SEQ ID NO: 17601

SEQ ID NO: 17607 - DNA, 990 bp, Homo sapiens; identical to SEQ ID NO: 17605

SEQ ID NO: 17608 - DNA, 1740 bp, Homo sapiens
gaggtcagaagaccgcgagattctcgccctgagcaacgagcgacggcctgacgtcggcggagggaagccggcccaggctcggtgaggaggcaaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcctgataatcatcctggccataatcgcaaaagagggcgactgtgcccctgaggagaaaatctgggaggagctgagtgtgttagaggtgtttgaggggagggaagacagtatcttcggggatcccaagaagctgctcacccaatatttcgtgcaggaaaactacctggagtaccggcaggtccccggcagtgatcctgcatgctatgagttcctgtggggtccaagggccctcattgaaaccagctatgtgaaagtcctgcaccatatggtaaagatcagtggaggacctcgcatttcctacccactcctgcatgagtgggctttgagagagggggaagagtgagtctgagcacgagttgcagccagggccagtgggagggggtttgggccagtgcaccttccggggccccatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttattcagattgggaaatccattccattttgtgaattgtgacataataatagcagtggaaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttca

SEQ ID NO: 17609 - DNA, 862 bp, Homo sapiens
agcaacgagcgacggcctgacgtcggcggagggaagccggcccaggctcggtgaggaggcaagtcctgcagcctcagcatgcgctggccggatgtaccctgaggtgccctctcacttcctccttcaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcc

SEQ ID NO: 17610 - DNA, 921 bp, Homo sapiens
gcccaggctcggtgaggaggcaagaatccgggctttgcccctggtatcaagtcacggaagctccgggaatggcggccaggcacgttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcctgataatcatcctggccataatcgcaaaagagggcgactgtgcccctgaggagaaaatctgggaggagctgagtgtgttagaggtgtttgaggggagggaaga

SEQ ID NO: 17611 - DNA, 1778 bp, Homo sapiens
gcggggatcagagagaagcgagggcctggttctgaggggtcggcttgagatcggctgagggaagcgggctcagggtctgtgaggaggcaaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaaatatcaaattaaggagccggtcacaaaggcagaaatgcttgagagtgtcatcaaaaattacaagaaccactttcctgatatcttcagcaaagcctctgagtgcatgcaggtgatctttggcattgatgtgaaggaagtggaccctgccggccactcctacatccttgtcacctgcctgggcctctcctatgatggcctgctgggtgatgatcagagtacgcccaagaccggcctcctgataatcgtcctgggcatgatcttaatggagggcagccgcgccccggaggaggcaatctgggaagcattgagtgtgatggggctgtatgatgggagggagcacagtgtctattggaagctcaggaagctgctcacccaagagtgggtgcaggagaactacctggagtaccgccaggcgcccggcagtgatcctgtgcgctacgagttcctgtggggtccaagggcccttgctgaaaccagctatgtgaaagtcctggagcatgtggtcagggtcaatgcaagagttcgcatttcctacccatccctgcatgaagaggctttgggagaggagaaaggagtttgagcaggagttgcagctagggccagtggggcaggttgtgggagggcctgggccagtgcacgttccagggccacatccaccactttccctgctctgttacatgaggcccattcttcactctgtgtttgaagagagcagtcacagttctcagtagtggggagcatgttgggtgtgagggaacacagtgtggaccatctctcagttcctgttctattgggcgatttggaggtttatctttgtttccttttggaattgttccaatgttccttctaatggatggtgtaatgaacttcaacattcattttatgtatgacagtagacagacttactgctttttatatagtttaggagtaagagtcttgcttttcatttatactgggaaacccatgttatttcttgaattcagacactacaagagcagaggattaaggtttttttagaaatgtgaaacaacatagcagtaaaatacatgagataaagacataaagaaattaaacaatagttaattcttgccttacctgtacctcttagtgtaccctatgtacctgaatttgcttggcttctttgagaatgaaattgaattaaatatgaataaataagtccccctg

SEQ ID NO: 17612 - DNA, 2112 bp, Homo sapiens
gttgtccacccaggtgagccctgggtggacggatgtgacgccactgacgtggccgcggggatcagagagaagcgagggcctggttctgaggggtcggcttgagatcggctgagggaagcgggctcagggtctgtgaggaggcaagcaggcaaaaaacagatgggggcccaacagaaatctgcccggcctcttttgtcacccctgagagcatgagcaggactatcagctgaggcccctgtgttataccagactcattggtctcagggagaagaaggccttggtctgagggcactgcattcaggtcagcagagcgggggtccaaggccctgccaggagtcagggactcagaggacaccactcaccaaacacacaggaccgaaccccaccctgcaccttctgtcagccatgggaagtgcagggaaaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaaatatcaaattaaggagccggtcacaaaggcagaaatgcttgagagtgtcatcaaaaattacaagaaccactttcctgatatcttcagcaaagcctctgagtgcatgcaggtgatctttggcattgatgtgaaggaagtggaccctgccggccactcctacatccttgtcacctgcctgggcctctcctatgatggcctgctgggtgatgatcagagtacgcccaagaccggcctcctgataatcgtcctgggcatgatcttaatggagggcagccgcgccccggaggaggcaatctgggaagcattgagtgtgatggggctgtatgatgggagggagcacagtgtctattggaagctcaggaagctgctcacccaagagtgggtgcaggagaactacctggagtaccgccaggcgcccggcagtgatcctgtgcgctacgagttcctgtggggtccaagggcccttgctgaaaccagctatgtgaaagtcctggagcatgtggtcagggtcaatgcaagagttcgcatttcctacccatccctgcatgaagaggctttgggagaggagaaaggagtttgagcaggagttgcagctagggccagtggggcaggttgtgggagggcctgggccagtgcacgttccagggccacatccaccactttccctgctctgttacatgaggcccattcttcactctgtgtttgaagagagcagtcacagttctcagtagtggggagcatgttgggtgtgagggaacacagtgtggaccatctctcagttcctgttctattgggcgatttggaggtttatctttgtttccttttggaattgttccaatgttccttctaatggatggtgtaatgaacttcaacattcattttatgtatgacagtagacagacttactgctttttatatagtttaggagtaagagtcttgcttttcatttatactgggaaacccatgttatttcttgaattcagacactacaagagcagaggattaaggtttttttagaaatgtgaaacaacatagcagtaaaatacatgagataaagacataaagaaattaaacaatagttaattcttgccttacctgtacctcttagtgtaccctatgtacctgaatttgcttggcttctttgagaatgaaattgaattaaatatgaataaataagtccccctgc

SEQ ID NO: 17613 - DNA, 2084 bp, Homo sapiens
gttgtccacccaggtgagccctgggtggacggatgtgacgccactgacgtggccgcggggatcagagagaagcgagggcctggttctgaggggtcggcttgagatcggctgagggaagcgggctcagggtctgtgaggaggcaaggagctccaggaaccaggctgtgaggtcttggtctgaggcagtatcttcaatcacagagcataagaggcccaggcagtagtagcagtcaagctgaggtggtgtttcccctgtatgtataccagaggcccctctggcatcagaacagcaggaaccccacagttcctggccctaccagcccttttgtcagtcctggagccttggcctttgccaggaggctgcaccctgagatgccctctcaatttctccttcaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaaatatcaaattaaggagccggtcacaaaggcagaaatgcttgagagtgtcatcaaaaattacaagaaccactttcctgatatcttcagcaaagcctctgagtgcatgcaggtgatctttggcattgatgtgaaggaagtggaccctgccggccactcctacatccttgtcacctgcctgggcctctcctatgatggcctgctgggtgatgatcagagtacgcccaagaccggcctcctgataatcgtcctgggcatgatcttaatggagggcagccgcgccccggaggaggcaatctgggaagcattgagtgtgatggggctgtatgatgggagggagcacagtgtctattggaagctcaggaagctgctcacccaagagtgggtgcaggagaactacctggagtaccgccaggcgcccggcagtgatcctgtgcgctacgagttcctgtggggtccaagggcccttgctgaaaccagctatgtgaaagtcctggagcatgtggtcagggtcaatgcaagagttcgcatttcctacccatccctgcatgaagaggctttgggagaggagaaaggagtttgagcaggagttgcagctagggccagtggggcaggttgtgggagggcctgggccagtgcacgttccagggccacatccaccactttccctgctctgttacatgaggcccattcttcactctgtgtttgaagagagcagtcacagttctcagtagtggggagcatgttgggtgtgagggaacacagtgtggaccatctctcagttcctgttctattgggcgatttggaggtttatctttgtttccttttggaattgttccaatgttccttctaatggatggtgtaatgaacttcaacattcattttatgtatgacagtagacagacttactgctttttatatagtttaggagtaagagtcttgcttttcatttatactgggaaacccatgttatttcttgaattcagacactacaagagcagaggattaaggtttttttagaaatgtgaaacaacatagcagtaaaatacatgagataaagacataaagaaattaaacaatagttaattcttgccttacctgtacctcttagtgtaccctatgtacctgaatttgcttggcttctttgagaatgaaattgaattaaatatgaataaataagtccccctgc

SEQ ID NO: 17614 - DNA, 1805 bp, Homo sapiens
ctgggggtcagagagaagggagaggcctccttctgaggggcggcttgataccggtggaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttcgctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaacatatacatgtatacctggatttgcttggcttctttgagcatgtaagagaaataaaaattgaaagaat

SEQ ID NO: 17615 - DNA, 551 bp, Homo sapiens
gtcactgacgtgcgcactgggggtcagagagaagggagaggcctccttctgaggggcggcttgataccggtggaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgag

SEQ ID NO: 17616 - DNA, 1139 bp, Homo sapiens
gagaagggagaggcctccttctgaggggcggcttgataccggtggaggtaagctggccgaggctctgtgaggagtcaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttggg

SEQ ID NO: 17617 - DNA, 887 bp, Homo sapiens
gagaagggagaggcctccttctgaggggcggcttgataccggtggaggtaagctggccgaggctctgtgaggagtcaaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcc

SEQ ID NO: 17618 - DNA, 594 bp, Homo sapiens
agagagtagcgggggcctcgctgtgaggggcgggtcgatatcggtggagggaagcgggcccaggctctgtgaggaggcaaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccag

SEQ ID NO: 17619 - DNA, 1814 bp, Homo sapiens
gtgcgcactgggggtcagagagaagggagaggcctccttctgaggggcggcttgataccggtggaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttcgctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaacatatacatgtatacctggatttgcttggcttctttgagcatgtaagagaaataaaaattgaaagaataa

SEQ ID NO: 17620 - DNA, 1866 bp, Homo sapiens
cagtgttgcaactgggcctggcatgtttcagtgtggtgtccagcagtgtctcccactccttgtgaagtctgaggttgcaaaaggactgtgatcatatgaagatcatccaggagtacaactcgaaattctcagaaaacaggaccttgatgtgagaggagcaggttcaggtaaacaaagggcgaggacccgagcgagcttaaggagtggggtgcagcgtctggtcagcggagggtgaattctcaggactggtcgggagtcaaggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcatatgagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaatta

SEQ ID NO: 17621 - DNA, 1708 bp, Homo sapiens
ttccgctttgaaggcgaggaccccagcgagcgtaagggcgcagtgtccgcctggcggatttgggtcagcaggcggaagtcgtcccaggctgctagatactaaggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcatatgagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaatta

SEQ ID NO: 17622 - DNA, 1782 bp, Homo sapiens
agtgttgcaactgggcctggcatgtttcagtgtggtgtccagcagtgtctcccactccttgtgaagtctgaggttgcaaaaggactgtgatcatatgaagatcatccaggagtacaactcgaaattctcagaaaacaggaccttgatgtgagaggagcaggttcaggtaaacaaagggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcatatgagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaatta

SEQ ID NO: 17623 - DNA, 1953 bp, Homo sapiens
gattggtatctggtcagcagagaaaggcatccaggccccgccaggagagacggtgcctcgctctgttgcccagactggagtgcagtggtgtgatcataactcagtatagcctagaactcctgagctcaagcaatcctcccacctcagcctttcaagcagctaggagtacagttgggagccactgtacctggttactgtcacgggatcacctgcctttttggctgctgcacctgaacagagtcatcatgcctcgaggtcagaagagtaaactccgtgccagggaaaaacgccgtcaggcccgaggagggctggaagatttgatagatgctctggacattttagaagaggaggaagaatctcccccctctgcctctgcttgtttgaaggatgttttccagagttcacttgatggggcatccaacaatccccatggacttcgggaagcccaatccaccagcacatctgctacagctgcttcacacacaagacatcccgaaggagtcaacgaccaaatggaagaaaggccaatatgcacacaagatctagaagccactgatagctttcccagaggccctgtagatgagaaagtaattatattggtgcattacttgctgtacaagtaccaaatgaaagagcccattacaaaggcagatatgctgagaaatgtaacccaaatgtccaagagccagttccctgtaatcctgagcagagcttctgagcacctggagctgatctttggtcttgacctgaaggaagtggagcctaataagcacatctatgtccttgtcaacaaactagatctaggctgtgatgcaaagctgagtgatgaaacaggcgtgcccaagactggcctgctgatgactgtcctgggtattatcttcacaaatggcaattgtgtcgctgaggaggaagtctggaaagtgtttaacacgatggggttatatgacggaattgagcacttcatgtttggggagcccaggaagctccttaccaaagatttggtgaaagaaaattacctggagtaccagcaagtgcccaacagtgatcctccacgctatcaattcctatggggcccaagagcccatgctgaaaccagcaagatgaaagttcttgagtttttggccaaggtaaatgatacagctcccagtgaattctcaaactggtatacagaggctttacaagatgaggaagagagagccagagccagagttgcagccaaggctcgcgttagtgccacagccggtgcacgttccaaggttaagtccagcaagtcctcccaactgcagtaaagtctgagggagattcttcatttgtgtttgaaaagaaatgcacattctgagctgtgggaggtcagggtgggactggagacaacacagtgaataatatgtttgtgttaatgttctatgtgatggcttggaatttttgaagatgttgttcctttaatagatggttaaagtagcttcactatctaagtttatgaatgacattgctcaaatttttctgtatgtgagattaagagtaagcgatttattgctttataagtctaattgggaaactctccatttatttagtgatcgaaacacgatagcatggtagtaaattaggcatttcctaattcaatgtgaaataatttaggagtgtaataaatgggatcaagaaatagagcaaagagggtcgggtgcggtggctcacacctgtaatcctagcactttgggaggccgaggcaggcggatcatgaggtcaggagatcaagaccatcttggctaacacagtgaaaccccgtctctactaaaaatacaaaaaattagccaggcgtggtggcgggttcctgtagtcctagctgctcaggaggctgaggcaggagaatggcgtaaacccgggaggcggagcttgcagtgagccaagatcacacgactgcattctagcctgggtgacagagcgagactctgtctc

SEQ ID NO: 17624 - DNA, 1667 bp, Homo sapiens
agtctgatataggcagtgtcgtgtcggcagaggaaggcatctcaggccctgcaggagtccaggcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacctagtgaagacaaggatagatgttttatgtaacatttgcagaaggcagttagtgttcaaggatgcaggtccagggtggggctggaggaaaaatagtatatatcatctatatccctattttgtatgtgtaacttgacagtttattcttttattttttaatggctatattattcagatgatgtttcttttaatagaagtttaggtagtttccagatctcttaagttttgaataatattggtcatccatttaatgtttttcatgaggtttagtggcatatgttttgctgattttgtaaaacagattgggaaaccatctatattgtgttctgatataggatgacatgacattactaagaactctgcttttaaatatccgtttaatgttttgcatgcagtttagtagcaaaggttttgttaattttgtaaaacagattagaaaaccatccatctatattgtgttctagtatagcatgacatgacattgctaagaactttgc

SEQ ID NO: 17625 - DNA, 1736 bp, Homo sapiens
tgtgacgaccttatctgaggaaggtgcaccctagtcatcagaggaacgagtcgctgcaggcactgtcaggtgtcgaggtgactcaggaggatgaggtattcttgaaggtggagagtggcattagtatactggcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacctagtgaagacaaggatagatgttttatgtaacatttgcagaaggcagttagtgttcaaggatgcaggtccagggtggggctggaggaaaaatagtatatatcatctatatccctattttgtatgtgtaacttgacagtttattcttttattttttaatggctatattattcagatgatgtttcttttaatagaagtttaggtagtttccagatctcttaagttttgaataatattggtcatccatttaatgtttttcatgaggtttagtggcatatgttttgctgattttgtaaaacagattgggaaaccatctatattgtgttctgatataggatgacatgacattactaagaactctgcttttaaatatccgtttaatgttttgcatgcagtttagtagcaaaggttttgttaattttgtaaaacagattagaaaaccatccatctatattgtgttctagtatagcatgacatgacattgctaagaactttgc

SEQ ID NO: 17626 - DNA, 1682 bp, Homo sapiens
tgtgacgaccttatctgaggaaggtgcaccctagtcatcagaggaacgagtcgctgcaggcactgtcaggtgtcgaggcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacctagtgaagacaaggatagatgttttatgtaacatttgcagaaggcagttagtgttcaaggatgcaggtccagggtggggctggaggaaaaatagtatatatcatctatatccctattttgtatgtgtaacttgacagtttattcttttattttttaatggctatattattcagatgatgtttcttttaatagaagtttaggtagtttccagatctcttaagttttgaataatattggtcatccatttaatgtttttcatgaggtttagtggcatatgttttgctgattttgtaaaacagattgggaaaccatctatattgtgttctgatataggatgacatgacattactaagaactctgcttttaaatatccgtttaatgttttgcatgcagtttagtagcaaaggttttgttaattttgtaaaacagattagaaaaccatccatctatattgtgttctagtatagcatgacatgacattgctaagaactttgc

SEQ ID NO: 17627 - DNA, 1818 bp, Homo sapiens
tgtgacgaccttatctgaggaaggtgcaccctagtcatcagaggaacgagtcgctgcaggcactgtcaggtgtcgaggtaaaactctgagactgagggaaatagagcgccctgcagataagagccccaggccctgcagtcaactctgggaggccgtgggctggactttcaggctgaacccaccccacatttctccctcgggaatctgattaaggcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacctagtgaagacaaggatagatgttttatgtaacatttgcagaaggcagttagtgttcaaggatgcaggtccagggtggggctggaggaaaaatagtatatatcatctatatccctattttgtatgtgtaacttgacagtttattcttttattttttaatggctatattattcagatgatgtttcttttaatagaagtttaggtagtttccagatctcttaagttttgaataatattggtcatccatttaatgtttttcatgaggtttagtggcatatgttttgctgattttgtaaaacagattgggaaaccatctatattgtgttctgatataggatgacatgacattactaagaactctgcttttaaatatccgtttaatgttttgcatgcagtttagtagcaaaggttttgttaattttgtaaaacagattagaaaaccatccatctatattgtgttctagtatagcatgacatgacattgctaagaactttgc

SEQ ID NO: 17628 - DNA, 1734 bp, Homo sapiens
tgtgacgaccttatctgaggaaggtgcaccctagtcatcagaggaacgagtcgctgcaggcactgtcaggtgtcgaggagtggcattagctatcagaagatggggactgaagcccaaccagtagtcaaagcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacctagtgaagacaaggatagatgttttatgtaacatttgcagaaggcagttagtgttcaaggatgcaggtccagggtggggctggaggaaaaatagtatatatcatctatatccctattttgtatgtgtaacttgacagtttattcttttattttttaatggctatattattcagatgatgtttcttttaatagaagtttaggtagtttccagatctcttaagttttgaataatattggtcatccatttaatgtttttcatgaggtttagtggcatatgttttgctgattttgtaaaacagattgggaaaccatctatattgtgttctgatataggatgacatgacattactaagaactctgcttttaaatatccgtttaatgttttgcatgcagtttagtagcaaaggttttgttaattttgtaaaacagattagaaaaccatccatctatattgtgttctagtatagcatgacatgacattgctaagaactttgc

SEQ ID NO: 17629 - DNA, 993 bp, Homo sapiens
atgcctcgcggtcaggcgagtaagcgccgtgcccgtgagaaacgccgccaggctcgaggtgaagaccaatgtctcgggggtgctcaagccaccgcagcagagaaggaaaagctgccatcctcctcctctcctgcatgccagagtcctccccagagcttccccaatgcaggcattcctcaggagtcccagagagccagctaccccagctctcctgcttcagctgtttcactcacaagttctgatgaaggtgccaagggccaaaagggggaaagtcccaactccttccatggcccgtcctcctctgagagcacaggaagagatcttctgaacacgaagacgggcgaattggtgcagttcctcctcaacaagtatataaggaaagagcccattacgagggaagccatgctgaaggttatcaacagaaagtacaagcagcacttccctgagatcctccggagaagcactgagaacgtagaggtggtctttggcctctacctgaaggaaatggaccccagccgtcagtcctatgtgcttgttggcaagctggactttcccaatcaaggaagcttgagcgatggcgggggctttcccctgagcgggctcctgatggttctcctgagcaccatcttcatgcatggcaaccgtgccactgaggaagagatgtgggaatgcctgaatgcattggggatgtataagggtaggaagcacttcatctatggggagccccaggagcttgtcaccaaagatttggtgcgagaggggtacctggagtaccagcaggtgcccagcagcgatcctccacgctacgagttcctgtggggtcccagggcccgtgctgaaaccagcaaaatgaaagtcctggagtttgtggccaagctcaatgataccgttgccagtacctacaagtcccggtatgaggaggctctgagagaggaggaagagcaagccagagccagagcggtagccagggatagcgccagggccagggctagc

SEQ ID NO: 17630 - DNA, 1379 bp, Homo sapiens
ggaagtgaggatcttcgtctgagggacgccacctcaggctaccagaaccccaagactggttgggtatcaagggtgttgcctgtagtgagctgaggatggagtcccaggactggtcaagtagcaaggtgaagatcctgagccctcagtagacagggctgcacggagcgtttcagcagagggctttggttgcaagactggctgccccaggtcagcggagaaaggagtcccaggctctgtggggagtgaaggtgcccacctcctgcaccctcttgcctgctgcccctaagcacagtcatcatgcctcgcggtcaggcgagtaagcgccgtgcccgtgagaaacgccgccaggctcgaggtgaagaccaatgtctcgggggtgctcaagccaccgcagcagagaaggaaaagctgccatcctcctcctctcctgcatgccagagtcctccccagagcttccccaatgcaggcattcctcaggagtcccagagagccagctaccccagctctcctgcttcagctgtttcactcacaagttctgatgaaggtgccaagggccaaaagggggaaagtcccaactccttccatggcccgtcctcctctgagagcacaggaagagatcttctgaacacgaagacgggcgaattggtgcagttcctcctcaacaagtatataaggaaagagcccattacgagggaagccatgctgaaggttatcaacagaaagtacaagcagcacttccctgagatcctccggagaagcactgagaacgtagaggtggtctttggcctctacctgaaggaaatggaccccagccgtcagtcctatgtgcttgttggcaagctggactttcccaatcaaggaagcttgagcgatggcgggggctttcccctgagcgggctcctgatggttctcctgagcaccatcttcatgcatggcaaccgtgccactgaggaagagatgtgggaatgcctgaatgcattggggatgtataagggtaggaagcacttcatctatggggagccccaggagcttgtcaccaaagatttggtgcgagaggggtacctggagtaccagcaggtgcccagcagcgatcctccacgctacgagttcctgtggggtcccagggcccgtgctgaaaccagcaaaatgaaagtcctggagtttgtggccaagctcaatgataccgttgccagtacctacaagtcccggtatgaggaggctctgagagaggaggaagagcaagccagagccagagcggtagccagggatagcgccagggccagggctagcaggtcctttcagccctagtgaagtctcaggcaatcctcactaagagattgaaaagcctgtccaccatctcagtatttgggggtgaggtg

SEQ ID NO: 17631 - DNA, 1434 bp, Homo sapiens
gatgctctaacgagggtagtgactctgtctaaaggcaaaagcacagttcagctgagggaggagaactggacactcattggagtcccggagaggacactgagtacactggagaggacttctatgcaaaaagggggcccgagcagagccccgccccgctttcagccctgggagacccagcagggacttgattggatgtggctcactccgacatccgcccgcctgggaagctgccggaagtgaggatcttcgtctgagggacgccacctcaggctaccagaaccccaagactggttgggtatcaaggtgcccacctcctgcaccctcttgcctgctgcccctaagcacagtcatcatgcctcgcggtcaggcgagtaagcgccgtgcccgtgagaaacgccgccaggctcgaggtgaagaccaatgtctcgggggtgctcaagccaccgcagcagagaaggaaaagctgccatcctcctcctctcctgcatgccagagtcctccccagagcttccccaatgcaggcattcctcaggagtcccagagagccagctaccccagctctcctgcttcagctgtttcactcacaagttctgatgaaggtgccaagggccaaaagggggaaagtcccaactccttccatggcccgtcctcctctgagagcacaggaagagatcttctgaacacgaagacgggcgaattggtgcagttcctcctcaacaagtatataaggaaagagcccattacgagggaagccatgctgaaggttatcaacagaaagtacaagcagcacttccctgagatcctccggagaagcactgagaacgtagaggtggtctttggcctctacctgaaggaaatggaccccagccgtcagtcctatgtgcttgttggcaagctggactttcccaatcaaggaagcttgagcgatggcgggggctttcccctgagcgggctcctgatggttctcctgagcaccatcttcatgcatggcaaccgtgccactgaggaagagatgtgggaatgcctgaatgcattggggatgtataagggtaggaagcacttcatctatggggagccccaggagcttgtcaccaaagatttggtgcgagaggggtacctggagtaccagcaggtgcccagcagcgatcctccacgctacgagttcctgtggggtcccagggcccgtgctgaaaccagcaaaatgaaagtcctggagtttgtggccaagctcaatgataccgttgccagtacctacaagtcccggtatgaggaggctctgagagaggaggaagagcaagccagagccagagcggtagccagggatagcgccagggccagggctagcaggtcctttcagccctagtgaagtctcaggcaatcctcactaagagattgaaaagcctgtccaccatctcagtatttgggggtgaggtg

SEQ ID NO: 17632 - DNA, 1610 bp, Homo sapiens
ctgacttccgctttggaggcgaggacccgagcgagtgtagggggtgcggcgtctggtcagccaggggtgaattctcaggactggtcggcagtcaagccatcatgcctcgtggtcagaagagtaagctccgtgcccgtgagaaacgccgcaaggcccgagatgagacccggggtctcaatgttcctcaggtcactgaagcagaggaagaagaggccccctgctgttcctcttctgtttctgggggtgctgcttcaagctctcctgctgctggcattccccaggagcctcagagagccccaaccactgccgctgctgcggctgcgggtgtttcatccacaaaatctaaaaaaggtgccaagagccaccaaggtgagaaaaatgcaagttcctcccaggcctcaacatccactaagagcccaagcgaagatcctctaaccaggaagtcagggtcgttggtgcagttcctgttgtacaagtataaaataaaaaagtccgttacaaagggagaaatgctgaaaattgttggcaaaaggttcagggagcacttccctgagatcctcaagaaagcctctgagggcctcagtgttgtctttggccttgagctgaataaagtcaaccccaacggccacacttacaccttcatcgacaaggtagacctcactgatgaggaatccctgctcagttcctgggactttcccaggagaaagcttctgatgcctctcctgggtgtgatcttcttaaatggcaactcagctactgaggaagagatctgggaattcctgaatatgttgggagtctatgatggagaggagcactcagtctttggggaaccctggaagctcatcaccaaagatctggtgcaggaaaaatatctggagtacaagcaggtgcccagcagtgatcccccacgctttcaattcctgtggggtccgagagcctatgctgaaaccagcaagatgaaagtcctggagtttttggccaaggtaaatggtaccaccccctgtgccttcccaacccattacgaagaagctttgaaagatgaagagaaagccggagtctgagccagagttgtagccaggccttgcactactgccatagccaatcaatctcccaaagccaagtttacctgctgttctcacccccaatgaggtcttaggcagattctttactttgtaattcaaaaggcctgttaacctttgttcttgttatgcatgaataacttgttgactttttttttttctctttttcaactagtgtttcaacaggtttatttagattcagaatgtaaatttacaaatgatatagatcaccctgttattgctgtttttcagggacagtagaaagtgttttgttttttgagtgaaacaacttattaataaaaatccttaaatcacttttgtaatccaggacaagaaaatgtggcattagagtagaaatatctttggaaatgtgaaagaccccatagtgaaatatttgggatcagaagccagaggtgtaaaagtggtcaattcttggtttacttcatttaatctttcttttcataaagatacatacctggatttgtttatgttattcaagaatgtgtgagaaattaaaccatagttagttaa

SEQ ID NO: 17633 - DNA, 2303 bp, Homo sapiens
ataacggggcaatctacccaaacctcttctcagcctagaatgccccaggcagtgcagtcagactgagcatcctctcttttacccttcagagttctcagtgaagtgagagttttgacctaaggtgacctcagttaactagagggaggatccagggtctggcagatatcagggaggaccttgaatgaagaacaggaggagccagaacagtgatgtcccatagaaacccgactccgctgtctgccctcacaggacccaaacatccctggcctaatgtggctcatcaaaacttcagcctagatctcggaggaccttgatctgagcaggattcatggcatggaatgtggagtcccaggactggccagcagcgaagtgaggttcttgagcagggctctggctcacgcttgtaatcccaacattttgggaggacgaagccagcctcatcgcttaagcacaggagttcgaggactgggaggtggaggttgtggcagggctgtggctcacgcttgtaatcccaacattttgggcggaggaagccagcctcatcgcttaagcacaggagttcgcggactgggaggcagggctctggctcacgcttgtaatcccaacattttgggaggacgaagccagcctcatcgcttaagcacaggagttcgaggactgggaggtggaggttgtggtgcctgtatcacctgcccttctgctgacactcctgcctgctgttcctgactacagccatcatgcctcggggtcagaagagtacgctccatgcacgtgagaaacgccagcagacccggggtcagacccaggatcaccagggtgctcagatcactgcaactaacaagaaaaaagtatccttttcatcccctcttattttgggggctactatccagaaaaagtctgctggtaggtcacgtagtgctctcaagaagcctcagagagcactatccaccactacatctgtagatgtttcttacaaaaagtcatacaagggagccaacagcaaaattgagaaaaagcaaagcttctctcagggtctatcctccactgtgcagtctcgcacagaccctctaatcatgaagacaaatatgttggtgcagttcctgatggaaatgtacaagatgaaaaagcccattatgaaagcagatatgctaaaaattgtccaaaaaagccataagaattgcttccctgagatccttaaaaaagcttctttcaacatggaggtggtatttggtgttgatttaaagaaagttgattctaccaaggactcctatgtccttgtcagcaaaatggatctccccaacaatgggacagtgactcgtgggaggggatttcccaagacaggtctcctgctgaatctcctgggcgtgatcttcatgaagggcaactgtgccactgaggagaagatctgggaattcctgaataagatgagaatatatgatgggaagaaacacttcatatttggggagcccagaaagctcatcacccaagatttggtgaagcttaaatacctggagtaccgacaagtgcccaacagtaatcctgcacgctatgaattcctgtggggtccaagagcccatgctgaaaccagcaagatgaaggtcctggagttttgggccaaggtcaataaaactgtccccagtgcgttccagttctggtatgaagaggctttgagagatgaggaagaaagagtccaagctgcagctatgctcaatgatggcagtagtgccatgggcagaaagtgttccaaggccaaggctagcagctcttcccacgcctagtgaagttgaagcaaattttgcattttgtggttaaagagggcagtcactgttccaaggagtgaaggactgggtgttactggagggaacacactgtataataccttttgtttctgttctaaatggataatttgaagttttatctgtattttggggcatatttttcaaatgttccttttatttaacattgtaatctaagtttaggattgatactggtcacatttgttgtttaagagtaaaaattttgctgttttgtaaaacagattgagaaaaattcgatcttatttagtgatctgttgcaagataacttggaattagaataagcatttccttgaaaatgtttaaaaaaaaaaagtcagcagtaaaatgtatggcattaagaaatagagaaagagtgtaagatggtcaatatttggtttcctaaatgcttttactctgtgctttaagaaaatgaaagataaataaccatatatgtctggcttacttaagaatgtagaattaaatcataataaattagacctcatgctg

SEQ ID NO: 17634 - DNA, 2302 bp, Homo sapiens
ataacggggcaatctacccaaacctcttctcagcctagaatgccccaggcagtgcagtcagactgagcatcctctcttttacccttcagagttctcagtgaagtgagagttttgacctaaggtgacctcagttaactagagggaggatccagggtctggcagatatcagggaggaccttgaatgaagaacaggaggagccagaacagtgatgtcccatagaaacccgactccgctgtctgccctcacaggacccaaacatccctggcctaatgtggctcatcaaaacttcagcctagatctcggaggaccttgatctgagcaggattcatggcatggaatgtggagtcccaggactggccagcagcgaagtgaggttcttgacagggctctggctcacgcttgtaatcccaacattttgggaggacgaagccagcctcatcgcttaagcacaggagttcgaggactgggaggtggaggttgtggcagggctgtggctcacgcttgtaatcccaacattttgggcggaggaagccagcctcatcgcttaagcacaggagttcgcggactgggaggcagggctctggctcacgcttgtaatcccaacattttgggaggacgaagccagcctcatcgcttaagcacaggagttcgaggactgggaggtggaggttgtggtgcctgtatcacctgcccttctgctgacactcctgcctgctgttcctgactacagccatcatgcctcggggtcagaagagtacgctccatgcacgtgagaaacgccagcagacccggggtcagacccaggatcaccagggtgctcagatcactgcaactaacaagaaaaaagtatccttttcatcccctcttattttgggggctactatccagaaaaagtctgctggtaggtcacgtagtgctctcaagaagcctcagagagcactatccaccactacatctgtagatgtttcttacaaaaagtcatacaagggagccaacagcaaaattgagaaaaagcaaagcttctctcagggtctatcctccactgtgcagtctcgcacagaccctctaatcatgaagacaaatatgttggtgcagttcctgatggaaatgtacaagatgaaaaagcccattatgaaagcagatatgctaaaaattgtccaaaaaagccataagaattgcttccctgagatccttaaaaaagcttctttcaacatggaggtggtatttggtgttgatttaaagaaagttgattctaccaaggactcctatgtccttgtcagcaaaatggatctccccaacaatgggacagtgactcgtgggaggggatttcccaagacaggtctcctgctgaatctcctgggcgtgatcttcatgaagggcaactgtgccactgaggagaagatctgggaattcctgaataagatgagaatatatgatgggaagaaacacttcatatttggggagcccagaaagctcatcacccaagatttggtgaagcttaaatacctggagtaccgacaagtgcccaacagtaatcctgcacgctatgaattcctgtggggtccaagagcccatgctgaaaccagcaagatgaaggtcctggagttttgggccaaggtcaataaaactgtccccagtgcgttccagttctggtatgaagaggctttgagagatgaggaagaaagagtccaagctgcagctatgctcaatgatggcagtagtgccatgggcagaaagtgttccaaggccaaggctagcagctcttcccacgcctagtgaagttgaagcaaattttgcattttgtggttaaagagggcagtcactgttccaaggagtgaaggactgggtgttactggagggaacacactgtataataccttttgtttctgttctaaatggataatttgaagttttatctgtattttggggcatatttttcaaatgttccttttatttaacattgtaatctaagtttaggattgatactggtcacatttgttgtttaagagtaaaaattttgctgttttgtaaaacagattgagaaaaattcgatcttatttagtgatctgttgcaagataacttggaattagaataagcatttccttgaaaatgtttaaaaaaaaaaagtcagcagtaaaatgtatggcattaagaaatagagaaagagtgtaagatggtcaatatttggtttcctaaatgcttttactctgtgctttaagaaaatgaaagataaataaccatatatgtctggcttacttaagaatgtagaattaaatcataataaattagacctcatgctg

SEQ ID NO: 17635 - DNA, 2237 bp, Homo sapiens
agaatgactaagaacaatagcccagtgaatacttagagcagtgttctcaaggaatcctgcagaggcggcttctgaaaagccaaggtagtatctgcctgctgaaggtgttctcaggatttcatttgctcttctccaggaaccacatcacctgcccttctgcctacactcctgcctgctgtgcctaaccacagccatcatgcctcggggtcagaagagtaagctccgtgcccgtgagaaacgccagcggacccgtggtcagacccaggatctcaaggttggtcagcctactgcagcagagaaagaagagtctccttcctcttcctcatctgttttgagggatactgcctccagctcccttgcttttggcattccccaggagcctcagagagagccacccaccacctctgctgctgcagctatgtcatgcactggatctgataaaggcgacgagagccaagatgaggaaaatgcaagttcctcccaggcctcaacatccactgagagatcactcaaagattctctaaccaggaagacgaagatgttagtgcagttcctgctgtacaagtataaaatgaaagagcccactacaaaggcagaaatgctgaagatcatcagcaaaaagtacaaggagcacttccctgagatcttcaggaaagtctctcagcgcacggagctggtctttggccttgccttgaaggaggtcaaccccaccactcactcctacatcctcgtcagcatgctaggccccaacgatggaaaccagagcagtgcctggacccttccaaggaatgggcttctgatgcctctactgagtgtgatcttcttaaatggcaactgtgcccgtgaagaggaaatctgggaattcctgaatatgctggggatctatgatggaaagaggcaccttatctttggggaaccccgaaagctcatcacccaagatctggtacaggaaaaatatctggaataccagcaggtgcccaacagtgatcccccacgctatcaattcctgtggggtccaagagctcatgcagaaaccagcaagatgaaagtcctggagtttttggccaaggtgaatgacaccacccccaataacttcccactgctttatgaagaggctttgagagatgaagaagagagagctggagcccggcccagagttgcagccaggcgtggcactacagccatgactagtgcgtattccagggccacatccagtagctcttcccaacccatgtgagatctaaggcaaattgttcactttgtggttgaaagacctgctgctttctctgttcctgtgatgcatgaataactcattgatttatctctttgttgtattttccatgatgtttcttaaaatagaaagtttatttagattcagaatataaatttagaaatggcatgcatcacacatttattgctgtttatcaggttggtttagtgataataattttgtttttgaaatacaaatagaaaatcctgaaataatttttgtgatacagagcaaaataacacggcatgggagtaaggttatccttagaaatttaaaataactccacagtaaaataggtagaatctgaagatagaaagggaagaaaagtaaaagttgctttattcgtggtttgtcttactcagttcagtctttttttgctcataaatttaaaagttacatacctggtttgcttagattattcaagaatgtggaggcctgggccaaggtcaatgacagtgtctccattgtcttccctccattaagagaagactttaagagatgagggagagagagccagagacagtgttgcaactgggcctggcatgtttcagtgtggtgtccagcagtgtctcccactccttgtgaagtctgaggtatattctttacttttgattaagaaaacacttaaccttctaattaatggagagccaaaggggagttggtgggaacaccatgtataacatatttgtatgtaaaatgatttatcttttctttttcctgtttttcagtgttctttttttaaattgtagatttatttagtttcagaatctaagtttatgaatggcatgaatcactcatttattaaaatatatcaggttggagagtgagaatttttgcattatgtaaaacaatttaaaaatcttttaagtctttttctgtgatctagaacaagataatatggcattggaatatggaatttgtgaaaaggaaattaccttgcaataaagttggtgggaccaggaagtag

SEQ ID NO: 17636 - DNA, 969 bp, Homo sapiens
atgacttctgcaggtgtttttaatgcaggatctgacgaaagggctaacagtagagatgaggagtacccatgttcctcagaggtctcaccctccactgagagttcatgcagcaatttcataaatattaaggtgggtttgttggagcagttcctgctctacaagttcaaaatgaaacagcgtattttgaaggaagatatgctgaagattgtcaacccaagataccaaaaccagtttgctgagattcacagaagagcttctgagcacattgaggttgtctttgcagttgacttgaaggaagtcaacccaacttgtcacttatatgaccttgtcagcaagctgaaactccccaacaatgggaggattcatgttggcaaagtgttacccaagactggtctcctcatgactttcctggttgtgatcttcctgaaaggcaactgtgccaacaaggaagatacctggaaatttctggatatgatgcaaatatatgatgggaagaagtactacatctatggagagcccaggaagctcatcactcaggatttcgtgaggctaacgtacctggagtaccaccaggtgccctgcagttatcctgcacactatcaattcctttggggtccaagagcctatactgaaaccagcaagatgaaagtcctggaatatttggccaaggtcaatgatattgctccaggtgccttctcatcacaatatgaagaggctttgcaagatgaggaagagagcccaagccagagatgcagccgaaactggcactactgcagtggccaagactgtctcagggcgaagttcagcagcttctctcaaccctattgaagtctgaagcttttttcatccagtcaagcaaatataacatcaccaaaagggattttttttggaaatacaaaagaacccccagtaaaataattgagataatgaaatagaaaaaaataataaaacatgatcttggttttcttc

SEQ ID NO: 17637 - DNA, 1949 bp, Homo sapiens
aataaaggggtctgagccggtcgcctgagcctgaaaagtgctgtcacgtcagcggaaggaggcgtcccagatcttctcagctgtcttggtgccagccttcctagtcttcctacccacactcctacctgctgtcacaggccacagccatcatgcctcggggtcacaagagtaagctccgtacctgtgagaaacgccaagagaccaatggtcagccacagggtctcacgggtccccaggccactgcagagaagcaggaagagtcccactcttcctcatcctcttctcgcgcttgtctgggtgattgtcgtaggtcttctgatgcctccattcctcaggagtctcagggagtgtcacccactgggtctcctgatgcagttgtttcatattcaaaatccgatgtggctgccaacggccaagatgagaaaagtccaagcacctcccgtgatgcctccgttcctcaggagtctcagggagcttcacccactggctctcctgatgcaggtgtttcaggctcaaaatatgatgtggctgccaacggccaagatgagaaaagtccaagcacttcccatgatgtctccgttcctcaggagtctcagggagcttcacccactggctcgcctgatgcaggtgtttcaggctcaaaatatgatgtggctgccgagggtgaagatgaggaaagtgtaagcgcctcacagaaagccatcatttttaagcgcttaagcaaagatgctgtaaagaagaaggcgtgcacgttggcgcaattcctgcagaagaagtttgagaagaaagagtccattttgaaggcagacatgctgaagtgtgtccgcagagagtacaagccctacttccctcagatcctcaacagaacctcccaacatttggtggtggcctttggcgttgaattgaaagaaatggattccagcggcgagtcctacacccttgtcagcaagctaggcctccccagtgaaggaattctgagtggtgataatgcgctgccgaagtcgggtctcctgatgtcgctcctggttgtgatcttcatgaacggcaactgtgccactgaagaggaggtctgggagttcctgggtctgttggggatatatgatgggatcctgcattcaatctatggggatgctcggaagatcattactgaagatttggtgcaagataagtacgtggtttaccggcaggtgtgcaacagtgatcctccatgctatgagttcctgtggggtccacgagcctatgctgaaaccaccaagatgagagtcctgcgtgttttggccgacagcagtaacaccagtcccggtttatacccacatctgtatgaagacgctttgatagatgaggtagagagagcattgagactgagagcttaaggcagggctggcactatttccttggccagggtaccttatggggccatatcctacagatcctcccatttctagggaggtctgaagtagaattttcactttatgttagaagagagtagtgagctttctaagtagtgcagtatagtagaggctggagggaacaagatatgtatctttcttttgttacacatgagtaacttgcagatttatgttttatctctgtcagttatcaacattgttcctgttaagtgaaggtttattttgcttcagattatacaattatcaataacatagctctcacattcatggctgtttaaccaatctgaaagttacggtttgggaattaataaaacaaagtcatacaacacattttctttgtaattgagaactagataacatggtaacagagaattgattttcatatgaatcttaactccacagtaaaatagttgacatcataatatgaagagaaagaaaaggaaaaacagaaatgtaaaagttgtttaattcttggtttgcctaattcgttttcctatttcttttcatacaaataaaggatacctggatttatttaggtta

SEQ ID NO: 17638 - DNA, 4270 bp, Homo sapiens
gtctgaaggacctgaggcattttgtgacgaggatcgtctcaggtcagcggagggaggagacttatagacctatccagtcttcaaggtgctccagaaagcaggagttgaagacctgggtgtgagggacacatacatcctaaaagcaccacagcagaggaggcccaggcagtgccaggagtcaaggttcccagaagacaaaccccctaggaagacaggcgacctgtgaggccctagagcaccaccttaagagaagaagagctgtaagccggcctttgtcagagccatcatgggggacaaggatatgcctactgctgggatgccgagtcttctccagagttcctctgagagtcctcagagttgtcctgagggggaggactcccagtctcctctccagattccccagagttctcctgagagcgacgacaccctgtatcctctccagagtcctcagagtcgttctgagggggaggactcctcggatcctctccagagacctcctgaggggaaggactcccagtctcctctccagattccccagagttctcctgagggcgacgacacccagtctcctctccagaattctcagagttctcctgaggggaaggactccctgtctcctctagagatttctcagagccctcctgagggtgaggatgtccagtctcctctgcagaatcctgcgagttccttcttctcctctgctttattgagtattttccagagttcccctgagagtactcaaagtccttttgagggttttccccagtctgttctccagattcctgtgagcgccgcctcctcctccactttagtgagtattttccagagttcccctgagagtactcaaagtccttttgagggttttccccagtctccactccagattcctgtgagccgctccttctcctccactttattgagtattttccagagttcccctgagagaactcagagtacttttgagggttttgcccagtctcctctccagattcctgtgagcccctcctcctcctccactttactgagtcttttccagagtttctctgagagaactcagagtacttttgagggttttgcccagtcttctctccagattcctgtgagcccctccttctcctccactttagtgagtcttttccagagttcccctgagagaactcagagtacttttgagggttttccccagtctcctctccagattcctgtgagctcctcctcctcctccactttattgagtcttttccagagttcccctgagagaactcacagtacttttgagggttttccccagtctcttctccagattcctatgacctcctccttctcctctactttattgagtattttccagagttctcctgagagtgctcaaagtacttttgagggttttccccagtctcctctccagattcctgggagcccctccttctcctccactttactgagtcttttccagagttcccctgagagaactcacagtacttttgagggttttccccagtctcctctccagattcctatgacctcctccttctcctctactttattgagtattttacagagttctcctgagagtgctcaaagtgcttttgagggttttccccagtctcctctccagattcctgtgagctcctctttctcctacactttattgagtcttttccagagttcccctgagagaactcacagtacttttgagggttttccccagtctcctctccagattcctgtgagctcctcctcctcctcctccactttattgagtcttttccagagttcccctgagtgtactcaaagtacttttgagggttttccccagtctcctctccagattcctcagagtcctcctgaaggggagaatacccattctcctctccagattgttccaagtcttcctgagtgggaggactccctgtctcctcactactttcctcagagccctcctcagggggaggactccctatctcctcactactttcctcagagccctcctcagggggaggactccctgtctcctcactactttcctcagagccctcagggggaggactccctgtctcctcactactttcctcagagccctcctcagggggaggactccatgtctcctctctactttcctcagagtcctcttcagggggaggaattccagtcttctctccagagccctgtgagcatctgctcctcctccactccatccagtcttccccagagtttccctgagagttctcagagtcctcctgaggggcctgtccagtctcctctccatagtcctcagagccctcctgaggggatgcactcccaatctcctctccagagtcctgagagtgctcctgagggggaggattccctgtctcctctccaaattcctcagagtcctcttgagggagaggactccctgtcttctctccattttcctcagagtcctcctgagtgggaggactccctctctcctctccactttcctcagtttcctcctcagggggaggacttccagtcttctctccagagtcctgtgagtatctgctcctcctccacttctttgagtcttccccagagtttccctgagagtcctcagagtcctcctgaggggcctgctcagtctcctctccagagacctgtcagctccttcttctcctacactttagcgagtcttctccaaagttcccatgagagtcctcagagtcctcctgaggggcctgcccagtctcctctccagagtcctgtgagctccttcccctcctccacttcatcgagtctttcccagagttctcctgtgagctccttcccctcctccacttcatcgagtctttccaagagttcccctgagagtcctctccagagtcctgtgatctccttctcctcctccacttcattgagcccattcagtgaagagtccagcagcccagtagatgaatatacaagttcctcagacaccttgctagagagtgattccttgacagacagcgagtccttgatagagagcgagcccttgttcacttatacactggatgaaaaggtggacgagttggcgcggtttcttctcctcaaatatcaagtgaagcagcctatcacaaaggcagagatgctgacgaatgtcatcagcaggtacacgggctactttcctgtgatcttcaggaaagcccgtgagttcatagagatactttttggcatttccctgagagaagtggaccctgatgactcctatgtctttgtaaacacattagacctcacctctgaggggtgtctgagtgatgagcagggcatgtcccagaaccgcctcctgattcttattctgagtatcatcttcataaagggcacctatgcctctgaggaggtcatctgggatgtgctgagtggaataggggtgcgtgctgggagggagcactttgcctttggggagcccagggagctcctcactaaagtttgggtgcaggaacattacctagagtaccgggaggtgcccaactcttctcctcctcgttacgaattcctgtggggtccaagagctcattcagaagtcattaagaggaaagtagtagagtttttggccatgctaaagaataccgtccctattacctttccatcctcttacaaggatgctttgaaagatgtggaagagagagcccaggccataattgacaccacagatgattcgactgccacagaaagtgcaagctccagtgtcatgtcccccagcttctcttctgagtgaagtctagggcagattcttccctctgagtttgaagggggcagtcgagtttctacgtggtggagggcctggttgaggctggagagaacacagtgctatttgcatttctgttccatatgggtagttatggggtttacctgttttacttttgggtatttttcaaatgcttttcctattaataacaggtttaaatagcttcagaatcctagtttatgcacatgagtcgcacatgtattgctgtttttctggtttaagagtaacagtttgatattttgtaaaaacaaaaacacacccaaacacaccacattgggaaaaccttctgcctcattttgtgatgtgtcacaggttaatgtggtgttactgtaggaattttcttgaaactgtgaaggaactctgcagttaaatagtggaataaagtaaaggattgttaatgtttgcatttcctcaggtcctttagtctgttgttcttgaaaactaaagatacatacctggtttgcttggcttacgtaagaaagtagaagaaagtaaactgtaataaataaaagtgtcagtgactca

SEQ ID NO: 17639 - DNA, 351 bp, Homo sapiens
ggggacaaggatatgcctactgctgggatgccgagtcttctccagagttcctctgagagtcctcagagttgtcctgagggggaggactcccaatctcctctccagattcctgtgagcccctcctcctcctccactttactgagtcttttccagagtttctctgagagaactcagagtacttttgagggttttgcccagtcttctctccagattcctgtgagcccctccttctcctccactttagtgagtcttttccagagttcccctgagagaactcagagtacttttgagggttttccccagtctcctctccagattcctgtgagctcctcctcctcctccactttattg

SEQ ID NO: 17640 - DNA, 613 bp, Homo sapiens
gaggatcgtctcaggtcagcggagggaggagacttatagacctatccagtcttcaaggtgctccagaaagcaggagttgaagacctgggtgtgagggacacatacatcctaaaagcaccacagcagaggaggcccaggcagtgccaggagtcaaggttcccagaagacaaaccccctaggaagacaggcgacctgtgaggccctagagcaccaccttaagagaagaagagctgtaagccggcctttgtcagagccatcatgggggacaaggatatgcctactgctgggatgccgagtcttctccagagttcctctgagagtcctcagagttgtcctgagggggaggactcccagtctcctctccagattcctgtgagcccctcctcctcctccactttactgagtcttttccagagtttctctgagagaactcagagtacttttgagggttttgcccagtcttctctccagattcctgtgagcccctccttctcctccactttagtgagtcttttccagagttcccctgagagaactcagagtacttttgagggttttccccagtctcctctccagattcctgtgagctcctcctcctcctccactttattga

SEQ ID NO: 17641 - DNA, 1084 bp, Homo sapiens
gccaggagtcaaggttcccagaagacaaaccccctaggaagacaggcgacctgtgaggccctagagcaccaccttaagagaagaagagctgtaagccggcctttgtcagagccatcatgggggacaaggatatgcctactgctgggatgccgagtcttctccagagttcctctgagagtcctcagagttgtcctgagggggaggactcccagtctcctctccagattccccagagttctcctgagagcgacgacacccttccttgatagagagcgagcccttgttcacttatacactggatgaaaaggtggacgagttggcgcggtttcttctcctcaaatatcaagtgaagcagcctatcacaaaggcagagatgctgacgaatgtcatcagcaggtacacgggctactttcctgtgatcttcaggaaagcccgtgagttcatagagatactttttggcatttccctgagagaagtggaccctgatgactcctatgtctttgtaaacacattagacctcacctctgaggggtgtctgagtgatgagcagggcatgtcccagaaccgcctcctgattcttattctgagtatcatcttcataaagggcacctatgcctctgaggaggtcatctgggatgtgctgagtggaataggggtgcgtgctgggagggagcactttgcctttggggagcccagggagctcctcactaaagtttgggtgcaggaacattacctagagtaccgggaggtgcccaactcttctcctcctcgttacgaattcctgtggggtccaagagctcattcagaagtcattaagaggaaagtagtagagtttttggccatgctaaagaataccgtccctattacctttccatcctcttacaaggatgctttgaaagatgtggaagagagagcccaggccataattgacaccacagatgattcgactgccacagaaagtgcaagctccagtgtcatgtcccccagcttctcttctgagtgaagtctagggcagattcttccctctgagtttgaagggggcagtcgagtttctacgtggtggagggcctggttgaggctggag

SEQ ID NO: 17642 - DNA, 1991 bp, Homo sapiens
gctttcccgacggccatcttgggaatctgacggatcgaaggcatttgtgaggaggcgcgaatcaagttagcggggggaagagtcttagacctggccagtcctcagggtgagggccctgaggaagaactgagggacctcccaccatagagagaagaaaccccggcctgtactgcgctgccgtgagactggtgctccaggaaccaggtggtgacgaactgggtgtgaggcacacagcctaaagtcagcacagcagaggaggcccaggcagtgccaggagtcaaggcctgttggatctcatcatccatatccctgttgatacgtttacctgctgctcctgaagaagtcgtcatgcctcccgttccaggcgttccattccgcaacgttgacaacgactccccgacctcagttgagttagaagactgggtagatgcacagcatcccacagatgaggaagaggaggaagcctcctccgcctcttccactttgtacttagtattttccccctcttctttctccacatcctcttctctgattcttggtggtcctgaggaggaggaggtgccctctggtgtgataccaaatcttaccgagagcattcccagtagtcctccacagggtcctccacagggtccttcccagagtcctctgagctcctgctgctcctctttttcatggagctcattcagtgaggagtccagcagccagaaaggggaggatacaggcacctgtcagggcctgccagacagtgagtcctctttcacatatacactagatgaaaaggtggccgagttagtggagttcctgctcctcaaatacgaagcagaggagcctgtaacagaggcagagatgctgatgattgtcatcaagtacaaagattactttcctgtgatactcaagagagcccgtgagttcatggagcttctttttggccttgccctgatagaagtgggccctgaccacttctgtgtgtttgcaaacacagtaggcctcaccgatgagggtagtgatgatgagggcatgcccgagaacagcctcctgattattattctgagtgtgatcttcataaagggcaactgtgcctctgaggaggtcatctgggaagtgctgaatgcagtaggggtatatgctgggagggagcacttcgtctatggggagcctagggagctcctcactaaagtttgggtgcagggacattacctggagtatcgggaggtgccccacagttctcctccatattatgaattcctgtggggtccgagagcccattcagaaagcatcaagaagaaagtactagagtttttagccaagctgaacaacactgttcctagttcctttccatcctggtacaaggatgctttgaaagatgtggaagagagagtccaggccacaattgataccgcagatgatgccactgtcatggccagtgaaagcctcagtgtcatgtccagcaacgtctccttttctgagtgaagtctaggatagtttcttccccttgtgtttgaacagggcagtttaggttctaggtagtggagggccaggtggggctcgaggaacgtagtgttctttgcatttctgtcccatatgggtgatgtagagatttacctgtttttcagtattttctaaatgcttttcctttgaatagcaggtagttagcttcagagtgttaatttatgaatattagtcgcacatgtattgctctttatctggtttaagagtaacagtttgatattttgttaaaaaaatggaaataccttctcccttattttgtgatctgtaacagggtagtgtggtattgtaataggcatttttttttttttttacaatgtgcaataactcagcagttaaatagtggaacaaaattgaagggtggtcagtagtttcatttccttgtcctgcttattcttttgttcttgaaaattatatatacctggctttgcttagcttgttgaagaaagtagcagaaattaaatcttaataaaagaaagccccac

SEQ ID NO: 17643 - DNA, 1932 bp, Homo sapiens
atgctgctgccctgccactgggtgttggatgccaccttcagtgatggcagtctaggccagtgggtgaaaaacacatgtgccacatatgccttatccccagtggtgctcccacctcagccccagccccggaaaaaggccacagataaggactattctgcctttcatcttgggcatctgagggaggtgaggctttttctgaggggtggaacttcagatcagcgaatggatagtcttgtcctctgccccacatacttcaagctctggaggaccctatcagggtccccaggtttacaactttctgacttgcattttgggagtcagccggaggggaagttttctctgaggagggcagtttcagttaagcagagggaggaaccccaggactggccactcaacgagaagagaactctgtggaaggacagtgaccttccaacatggaggagaggcacaggctacaccctttcccttcctgccgtcagccctggaaaaaggttgtggggggagaaagcggggagcttgccagagagcgagcccttgttcacttatacactggatgaaaaggtggacaagttggtgcagtttcttctcctcaaatatcaagcaaaagagcctctcacaagagcagagatgcagatgaatgtcatcaacacatacacgggctactttcctatgatcttcaggaaagcccgtgagttcatagagattctttttggcatttccctgacagaagtggaccccgaccatttctatgtctttgtaaacacattagacctcacctgtgaggggagtctgagtgatgagcagggcatgccccagaaccgcctcctgattcttattctgagtgtgatcttcataaagggcaactgtgcatctgaggaggtcatctgggaagtgctgaatgcaatagggccctggtcagccttggcagggttcgcggatgtgctttcccgacttgcactgtgggagtctgaaggacctgaagcattttgcgaggagtctggactcaggtcagcagagggaagcgtcttagacctggccaatcctcaaggacttgcaggccacagacaggaagatggccgccgagggctgaccgaggcgtccccacaacagaagaagggaggagaagatgaggatatgcctgctgctgggatgccacctcttccccagagtcctcctgagattcctccccagggtcctcccaagatctctccccagggtcctccgcagagtcctccccagagtcctctagactcctgctcatcccctcttttgtggacccgattggatgaggagtccagcagtgaagaggaggatacagctacttggcatgccttgccagaaagtgaatccttgcccaggtatgccctggatgaaaaggtggctgagttggtgcagtttcttctcctcaaatatcaaacaaaagagcctgtcacaaaggcagagatgctgacgactgtcatcaagaagtataaggactattttcccatgatcttcgggaaagcccatgagttcatagagctaatttttggcattgccctgactgatatggaccccgacaaccactcctatttctttgaagacacattagacctcacctatgagggaagcctgattgatgaccagggcatgcccaagaactgtctcctgattcttattctcagtatgatcttcataaagggcagctgtgtccccgaggaggtcatctgggaagtgttgagtgcaatagggcccattcagaggccagcaagagaagtcttagagtttttatccaagctatccagtatcatccctagtgcctttccatcctggtacatggatgctttgaaagatatggaagacagagcccaggccataattgacaccacagatgatgctactgccatggccagtgcaagccccagtgtcatgtccaccaacttctgtcctgagtga

SEQ ID NO: 17644 - DNA, 1100 bp, Homo sapiens
gtcagcacagcagaggaggcccaggcaatatcaggagtcaaggttctgagggagcaaacctcttaggaagacaggcgacctgtgaggccctagagcaccaccttaagagaagaagagctgtaagccagcctttgtcagaaccatcatagaagatgaggatatgcctgctgctgggatgccacctcttccccagagtcctcctgagattcctccccagggtcctcccaagatctctccccagggtcctccgcagagtcctccccagagtcctctagactcctgctcatcccctcttttgtggacccgattggatgaggagtccagcagtgaagaggaggatacagctacttggcatgccttgccagaaagtgaatccttgcccaggtatgccctggatgaaaaggtggctgagttggtgcagtttcttctcctcaaatatcaaacaaaagagcctgtcacaaaggcagagatgctgacgactgtcatcaagaagtataaggactattttcccatgatcttcgggaaagcccatgagttcatagagctaatttttggcattgccctgactgatatggaccccgacaaccactcctatttctttgaagacacattagacctcacctatgagggaagcctgattgatgaccagggcatgcccaagaactgtctcctgattcttattctcagtatgatcttcataaagggcagctgtgtccccgaggaggtcatctgggaagtgttgagtgcaataggggtgtgtgctgggagggagcactttatatatggggatcccagaaagctgctcactatacattgggtgcagagaaagtacctggagtaccgggaggtgcccaacagtgctcctccacgttatgaatttttgtggggtccaagagcccattcagaggccagcaagagaagtcttagagtttttatccaagctatccagtatcatccctagtgcctttccatcctggtacatggatgctttgaaagatatggaagacagagcccaggccataattgacaccacagatgatgctactgccatggccagtgcaagccccagtgtcatgtccaccaacttctgtcctgagtga

SEQ ID NO: 17645 - DNA, 966 bp, Homo sapiens
ttaaattctgatgggaccatgcagtccagaactgtggggctctgggagtctggtcagccccagctgtcagccttgggaggcccaagactctgcttgcagtctttagcctgaggggctccctcacttcctcttgcaggtgctccaggaaccaggagttgaagacctgggtctgaggcacacttcctaaagtcagcacagcagaggaggcccaggcaatatcaggagtcaaggttcccaggggacaaaccccctaggatggcaggtgacccgtgaggccctagagcaccaccttaagagaagaagagctgtaagccggcctttgtcagaaccaccatggacacggggcagcttcagttaagcagagaaaggagccccggggctggccaacaagcaagaagggaactctgtggaaggatagctatctcccaacacggagggaaggcccaggcgtcgcccagccactccttgctgtcacccctggacaaaacagatggagagccctggtcagccttggcagggttcgcggatgtgctttcccgacttgcactgtgggagtctgaaggacctgaagcattttgcgaggagtctggactcaggtcagcagagggaagcgtcttagacctggccaatcctcaaggtaagggccctaagggagaactgagggacttcgcaccaaggacagaagaagccccggtctgccctgcgctgccataggacttgcaggccacagacaggaagatggccgccgagggctgaccgaggcgtccccacaacagaagaagggaggaggtgccagccctctagggaataaataggaagacattgaggaggactgggggaacccccacctcagaggacagcttcccagagattcccaccctgctcctcatatcagccctcgtagagctcctcagtcagctcaggctgagcggcagtcctctcattgctgggggaggggtggagggg

SEQ ID NO: 17646 - DNA, 1290 bp, Homo sapiens
gtcagcacagcagaggaggcccaggcaatatcaggagtcaaggcctgtgggatcccatcatccccatccctgctcacacgtttacctgctgctcctgaacaacaggcctcatgcctctctttccaaaccttccacgcctcagctttgaggaagacttccagaacccgagtgtgacagaggacttggtagatgcacaggattccatagatgaggaggaggaggatgcctcctccacttcctcttcctctttccactttttattcccctcctcctcttccttgtcctcatcctcacccttgtcctcacccttaccctctactctcattctgggtgttccagaagatgaggatatgcctgctgctgggatgccacctcttccccagagtcctcctgagattcctccccagggtcctcccaagatctctccccagggtcctccgcagagtcctccccagagtcctctagactcctgctcatcccctcttttgtggacccgattggatgaggagtccagcagtgaagaggaggatacagctacttggcatgccttgccagaaagtgaatccttgcccaggtatgccctggatgaaaaggtggctgagttggtgcagtttcttctcctcaaatatcaaacaaaagagcctgtcacaaaggcagagatgctgacgactgtcatcaagaagtataaggactattttcccatgatcttcgggaaagcccatgagttcatagagctaatttttggcattgccctgactgatatggaccccgacaaccactcctatttctttgaagacacattagacctcacctatgagggaagcctgattgatgaccagggcatgcccaagaactgtctcctgattcttattctcagtatgatcttcataaagggcagctgtgtccccgaggaggtcatctgggaagtgttgagtgcaataggggtgtgtgctgggagggagcactttatatatggggatcccagaaagctgctcactatacattgggtgcagagaaagtacctggagtaccgggaggtgcccaacagtgctcctccacgttatgaatttttgtggggtccaagagcccattcagaggccagcaagagaagtcttagagtttttatccaagctatccagtatcatccctagtgcctttccatcctggtacatggatgctttgaaagatatggaagacagagcccaggccataattgacaccacagatgatgctactgccatggccagtgcaagccccagtgtcatgtccaccaacttctgtcctgagtga

SEQ ID NO: 17647 - DNA, 1707 bp, Homo sapiens
gaaaggagccccggggctggccaacaagcaagaagggaactctgtggaaggatagctatctcccaacacggagggaaggcccaggcgtcgcccagccactccttgctgtcacccctggacaaaacagatggagaggtgaaaacggagagccctggtcagccttggcagggttcgcggatgtgctttcccgacttgcactgtgggagtctgaaggacctgaagcattttgcgaggagtctggactcaggtcagcagagggaagcgtcttagacctggccaatcctcaaggtgctccaggaaccaggagttgaagacctgggtctgaggcacacttcctaaagtcagcacagcagaggaggcccaggcaatatcaggagtcaaggttctgagggagcaaacctcttaggaagacaggcgacctgtgaggccctagagcaccaccttaagagaagaagagctgcctgtgggatcccatcatccccatccctgctcacacgtttacctgctgctcctgaacaacaggcctcatgcctctctttccaaaccttccacgcctcagctttgaggaagacttccagaacccgagtgtgacagaggacttggtagatgcacaggattccatagatgaggaggaggaggatgcctcctccacttcctcttcctctttccactttttattcccctcctcctcttccttgtcctcatcctcacccttgtcctcacccttaccctctactctcattctgggtgttccagaagatgaggatatgcctgctgctgggatgccacctcttccccagagtcctcctgagattcctccccagggtcctcccaagatctctccccagggtcctccgcagagtcctccccagagtcctctagactcctgctcatcccctcttttgtggacccgattggatgaggagtccagcagtgaagaggaggatacagctacttggcatgccttgccagaaagtgaatccttgcccaggtatgccctggatgaaaaggtggctgagttggtgcagtttcttctcctcaaatatcaaacaaaagagcctgtcacaaaggcagagatgctgacgactgtcatcaagaagtataaggactattttcccatgatcttcgggaaagcccatgagttcatagagctaatttttggcattgccctgactgatatggaccccgacaaccactcctatttctttgaagacacattagacctcacctatgagggaagcctgattgatgaccagggcatgcccaagaactgtctcctgattcttattctcagtatgatcttcataaagggcagctgtgtccccgaggaggtcatctgggaagtgttgagtgcaataggggtgtgtgctgggagggagcactttatatatggggatcccagaaagctgctcactatacattgggtgcagagaaagtacctggagtaccgggaggtgcccaacagtgctcctccacgttatgaatttttgtggggtccaagagcccattcagaggccagcaagagaagtcttagagtttttatccaagctatccagtatcatccctagtgcctttccatcctggtacatggatgctttgaaagatatggaagacagagcccaggccataattgacaccacagatgatgctactgccatggccagtgcaagccccagtgtcatgtccaccaacttctgtcctgagtga

SEQ ID NO: 17648 - DNA, 2747 bp, Homo sapiens
ggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaatta

SEQ ID NO: 17649 - DNA, 2875 bp, Homo sapiens
attttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaa

SEQ ID NO: 17650 - DNA, 2806 bp, Homo sapiens
cgggactgactttggctcttcagtgtttgcgcatgcgcgtaacgtcctgaggcggtgggtggtatattaggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaa

SEQ ID NO: 17651 - DNA, 2701 bp, Homo sapiens
gaagttgcctgaagtgaaggagggggtagcggctgcagaagctaaagcttccgccaaacaaaagaggacagcacttccggtcacgccatcgttgctgccttcttcgtcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaa

SEQ ID NO: 17652 - DNA, 1528 bp, Homo sapiens
attttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcagtctctcaatgccaatgacctggccaacagcaggcctaagacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctctt

SEQ ID NO: 17653 - DNA, 1932 bp, Homo sapiens
ggagggcagtctccgagtttcggaggggcttggagtgagtggacgcactcgggaattgtaggaggacgaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtat

SEQ ID NO: 17654 - DNA, 1848 bp, Homo sapiens
tagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtat

SEQ ID NO: 17655 - DNA, 2169 bp, Homo sapiens
gacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaagggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtatctgccttggtttcagtggggacatctggggcttatggggctgggatgaggagctggatgattctaggaaggcccaagttggagaatgatgtggagagtgtgccaagacactgcttttggcattttattcctttctgtttgctggatgtcaattgacccttttattttctcttacttgtgttttcagatattgttaatcctgccagtctttctcttcaagccagggtgcatcctcagaaacctactcaacacagcactctaggcagccactatcaatcaattgaagttgacactctgcattaaatctatttgcc

SEQ ID NO: 17656 - DNA, 1927 bp, Homo sapiens
ggaggctgagacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtat

SEQ ID NO: 17657 - DNA, 2048 bp, Homo sapiens
agtctccgagtttcggaggggcttggagtgagtggacgcactcgggaattgtaggaggacgaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgcc

SEQ ID NO: 17658 - DNA, 1798 bp, Homo sapiens
agtctccgagtttcggaggggcttggagtgagtggacgcactcgggaattgtaggaggacgaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttc

SEQ ID NO: 17659 - DNA, 1647 bp, Homo sapiens
tagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtat

SEQ ID NO: 17660 - DNA, 2189 bp, Homo sapiens
agtggcataaacatgggctttggcgtcagacagccctgagcggggccccattgccccacccccgaggaaggcgagggggggtggcagggggctgcggaaaggggctgggctgggttgggctgtctgcagctctagtccaggaggctgagacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgcc

SEQ ID NO: 17661 - DNA, 2026 bp, Homo sapiens
gggaaaaggggcggggtcctcagagctgccgcgctggcacatcttcctggagaaggggagggtgcggctgcagagaattgagacttagaagctttgaattcctgtatctgagaacggagtcgttgggggtggtggagggggttggaattggggacctacggaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtat

SEQ ID NO: 17662 - DNA, 2495 bp, Homo sapiens
gcggctgcggggttcctggtgctgaggacggacgccattggagttcccgagaagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 17663 - DNA, 2650 bp, Homo sapiens
gcatgcgcaggctacccagccgcggggggtgcacggagaaaaggggcggggtggtccgggctgctgtgctggcagcagtaggcgagggcgcggctgcggggttcctggtgctgaggacggacgccattggagttcccgagaaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagaacccggagctcagagaggagacgcctctgagcatggctcccagctggtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 17664 - DNA, 2578 bp, Homo sapiens
gggggtgcacggagaaaaggggcggggtggtccgggctgctgtgctggcagcagtaggcgagggcgcggctgcggggttcctggtgctgaggacggacgccattggagttcccgagaaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 17665 - DNA, 2510 bp, Homo sapiens
gcagtaggcgagggcgcggctgcggggttcctggtgctgaggacggacgccattggagttcccgagaagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 17666 - DNA, 2650 bp, Homo sapiens; identical to SEQ ID NO: 17663

SEQ ID NO: 17667 - DNA, 2482 bp, Homo sapiens
cggctgcggggttcctggtgctgaggacggacgccattggagttcccgagaagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 17668 - DNA, 3699 bp, Homo sapiens
agagccagtctgcgcctgcgcggactgcggcagagggcggggtgtgagaagcagagtacagtgagactagcattcactgctggccagtgcctgcctttttcaccacctctaatttcagcttcagcagttgcttggaactttggttctggcagcagcagcaacatcattaccgctagcggcagttttgtgccgaggcacctacacacctcccgtcctctctgccagatcgcgggcctgtcggtgtctgctcctacacgccaacgccggtgggcaggaccatgtctctggtaagccagaattcgcgccgccgccgccgccgcgttgcaaaggctactgcgcacaacagcagctggggcgaaatgcaggcccctaatgcccccggtctccccgctgatgtgccaggctcagacgtcccccagggtcccagcgattcccagatcctccagggcctctgcgcctctgagggcccaagcacctccgttctgcccacctccgctgagggcccaagcacctttgtgccgcccaccatctctgaggcctcaagcgcctccgggcagcccaccatctctgagggacctggcacctccgtgctgcccacccccagtgagggcctaagcacctccgggcctcccaccatctctaaggggctgtgcacctctgtgacgcttgccgcctctgagggccggaacacctccaggccgcccacttcctctgaggaacctagcacctccgtgccgcccaccgcctctgaggtaccgagcacctccctgccgcccacccctggtgagggaacgagcacctccgtgccgcccacagcctatgagggaccaagcacctccgtggtgcccacccctgatgagggaccaagcacctccgtgctgcctacacctggtgagggaccaggcacctccgtgccgctcgccgccactgagggcctgagcacctccgtgcaggccactcctgatgagggaccgagcacctccgtgccgcccaccgccactgagggcctaagcacccccgtgccacccacccgtgatgagggaccgagcacctccgtgccggccactcctggtgagggaccgagcacctccgtgctgcccgccgcctctgacggacaaagcatctccttggtgcccacccgcggtaagggatcaagcacctccgtgccccccaccgccaccgagggcctgagcacctccgtgcagcccactgctggtgagggatcgagcacctccgtgccgcccacccctggtgggggactgagcacctccgtgccgcccaccgccactgaggagttgagcacctccgtgccgcccactcccggtgagggaccaagcacttccgtactgccaatccccggtgagggactgagcacctctgtgccgcccaccgcctctgatggatcggacacctccgtgccgcccactcctggtgagggcgcaagcaccttagtgcagcccaccgcccctgacggaccgggaagctccgtgctgcctaaccctggtgagggcccgagcacattgtttagctctagtgcttctgtggaccggaacccctccaagtgttcccttgttttgccaagccctagggtaaccaaggcctccgtggactcagattctgagggtcctaagggtgcagaaggccctatagaattcgaggtcctgagagactgtgagagccccaactccattagtattatgggcctcaatacttcccgggttgcaattaccctgaagccccaagaccctatggaacagaacgtagctgagctgttgcagttcctgctggtgaaggatcagagcaagtaccctatccgggagtctgaaatgcgggaatatattgttaaagaatatcgcaaccagtttcctgagatactcaggcgagcagcagcccacctggagtgcatttttaggtttgaattgagagaacttgaccctgaggcacacacctacattctgttaaacaaactgggacctgtgccctttgaagggttagaagagagcccaaatgggccaaagatgggcctcctgatgatgattctaggccaaatattcctgaatggcaaccaagccaaggaggctgagatttgggaaatgctctggaggatgggggtgcagcgggaaaggaggctttccatttttgggaacccaaagagacttctgtctgtggagtttgtatggcagcgttacttagactacaggccagtaactgactgtaaaccagtggagtatgagtttttctggggcccaagatcccacctagaaaccaccaagatgaaaattctgaagttcatggcgaaaatatataacaaagatcctatggattggccagagaaatacaacgaagctctggaagaagatgctgccagagcctttgctgagggttggcaggctctccctcactttaggaggcccttttttgaggaagctgctgcagaggtaccatcccctgattcagaggtttccagctattcctcaaaatatgccccacattcatggcctgagtcaagattggagagcaaggcaaggaagctggtgcagttatttctgcttatggattcaactaagctgcctataccaaagaaaggaattctgtactacattggccgagagtgcagcaaagtgttccctgacctcctgaatcgtgctgcccgcaccctgaaccatgtctatgggacagaactagtggtacttgatcccaggaatcactcctatactctgtacaaccgaagggagatggaagaaactgaggagatcgtagacagtccaaacaggcctggcaacaactttttgatgcaggtcctaagcttcatctttattatgggcaaccatgccagggagtctgcagtctgggcctttctgcggggcttaggggttcaagctgggagaaagcatgtgattacctgcagatacttgagtcagcgctatatagacagtttacgggttcctgacagtgatccagtgcaatatgagtttgtatggggtcctagagcccgtttggaaacctctaagatgaaagccttgcgatatgtggccagaatccacagaaaggaaccacaggactggccacagcagtacagggaggcaatggaagatgaggccaatagagctgatgttgggcacaggcaaatctttgttcacaacttcaggtagaggaatgcatggcagtcagaggggccttgcaaggaggggcctttgagcctcagttctcatgtattggggggtgggggtgggtacatattgtatttggtatttgtgttccagttatatttatgtcttttcatatttagttctggtgtggtgtctggaaatgtttcaactgttttaatatattgtctgattgggtaaatgtgattgaccacttgctgtctctgttgtattttggtatgagttttgatagctctataaaatgttttggaaatctttccatcttgttgcattatctagaaaagaatatagcatatagctatagatataggcttttccttgaaagcttgaaaaaaattcgccagtaaaataatctagcttaaagtgataaactaacaaacaaatataacaacaactgaaaaggcactctaaattgtggctggcttccctttctgtctgctattgtatgaagaatactgatgtttacctgtatttgctttgctgtactaaaatgtaatgaaaaataaaagattaataaatgaaacataatgct

SEQ ID NO: 17669 - DNA, 2257 bp, Homo sapiens
aacgctctgaggcttgcagtcgttgctggccagcacttgtgtagaaagatcgctcttcacaccagatttcacttttgatccttccagctccagggtctcgggcttcagctttgtgccgaggcaccaacactgctgcggtcctctctccgactgatcgctgatctcaccgttcccgctcctgtctcctggaaccatgtctctggtaagccagaatgcacgccactgtagcgcagagatcactgcagattacggcgacggcagaggtgaaatacaagctactaacgcctccgggtcccccacctccatgctagtcgttgatgccccccagtgccctcaggcgccaatcaactctcagtgtgtcaacacttcccaggccgttcaggacccgaatgacctggaggtcctgatcgacgagcagtccagacgtttgggggcgctcagggtccatgaccctctagaagacaggtcgattgctttggtgaatttcatgagaatgaaaagccagacggaggggtctatccagcagtccgagatgctggagtttctcagagagtactcagatcagttccctgagatcctcagacgagcctcagctcacctggaccaggtctttgggttgaacctgagagttattgatcctcaggctgacacctacaatttagtcagcaaacggggtttccagatcaccgataggatagcggagtccctggacatgccaaaagcaagtctcctggccctagtcctaggccacatcctcttgaatgggaaccgagcaagagaggcctccatttgggacttgctgctaaaagttgatatgtgggataagcctcagaggatcaacaacctctttgggaacacaaggaacctcctcactactgactttgtgtgcatgcgattcttggagtactggccggtgtatggcactaatccccttgagtttgagttcttgtggggctctagagcccacagggaaatcacaaagatggaagccctgaagtttgtgtcagatgcccatgatgaagaaccctggagctggccagaagaatataataaggccctggaaggtgacaaaaccaaagaaagaagcctgactgctggcttagagttctggtcggaggacactatgaatgataaggcaaatgatttggtccagttggctattagtgtcactgaggagatgctgcctatacatcaggatgagctattggctcacactggcaaagaatttgaggatgtgttcccaaatatcctcaatagagctactctaattcttgatatgttctatgggttgtctctgattgaggttgataccagtgagcacatctacctccttgtccagcaaccagaatcagaggaagagcaagtgatgctagagagcctggggagacccactcaagaatatgtaatgccaatcctaggtttgatcttcctgatgggcaaccgtgtcaaagaggccaatgtctggaacttgcttcgaagatttagtgtggatgtagggagaaagcattccatcacccgtaagcttatgagacagcgctatctggaatgcaggccactgtcctactctaatccagttgaatatgagcttctatggggtcctcgagctcaccatgaaaccatcaaaatgaaagtcttggagtacatggccaggctctacagaaagcgaccacagaactggccagaacaatatagggaggctgtggaagatgaggaggccagagccaaatctgaggcaactatcatgtttttccttgaccccacgtgaagtctagggaatatgtatcacttcagctgagtggcataagttaaagatgccttggtaaaataggcattggggctctaaattagaatccaggtagggcttgtgtgggaagtacaaattgtgcttgctgtctgtgttccaattctagtagtatttccttccttttaatatactcttggattaggttaatgaccaatatttataaatggaatttttcatttgccatcccggtcttgtttcagcataaaagttcagacagctctgtaaaatgtattgataatatttacatctttgaaataatcagtaaaatggtctggtacaggagttaaataacaatgacacacacacaacaaaacaaacacaaaaccactgatctgtgattgctctccctttgtgtctactgccgtatacatatatacaactatatatacacaaatatatatatacacaaaactgtcatttacctgtatttgcaataaaagcataatgaattag

SEQ ID NO: 17670 - DNA, 1681 bp, Homo sapiens
gcgggcgcggactgaggctgcgcgccgcaggttccggctgctggcggcgttgcggccgcaggtttgactcccgtgcggtgcggcccagcagccacaaagctcccgctgccattgctccttgtactcccgccgtcactgccgctgtccaacccctcccccggggcttgcgcggcggctcccacacccctcggcccgtgtacgcgctctgcacctgcctgcccgaaaacatgttgcagacaccagagagcagggggctcccggtcccgcaggccgagggggagaaggatggcggccatgatggtgagacccgggccccgaccgcctcgcaggagcgccccaaggaggagcttggcgccgggagggaggagggggctgcggagcccgccctcacccggaaaggcgcgagggccttggcggccaaagccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggaggatctgggaggagatggccccagattgggtctgttaatgatgatcctgggccttatctatatgagaggtaatagcgccagggaggcccaggtctgggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtgg

SEQ ID NO: 17671 - DNA, 611 bp, Homo sapiens
cttctaggtggtgtgggcgaagtttgggactggtttagggcggggacaagaccaagaacacaagtttccttgtactacgggagagagggaggggaggaaattggagaccccagcacccccttgctcactctcttgctcacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttggctttatgcaaatacaatcagcccagtgc

SEQ ID NO: 17672 - DNA, 1140 bp, Homo sapiens
ccggggagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccataccccaagagctcccaaagcctgagaccagggtcatttgtccccaactccccatctggccctgctgttgctagtacctgttatttattacctggaggcctgtccagcacccaccctacccccataaagcattgtttacacctg

SEQ ID NO: 17673 - DNA, 943 bp, Homo sapiens
ggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccataccccaagagctcccaaagcctgagaccagggtcatttgtccccaactccccatctggccctgctgttgctagtacctgttatttattacctggaggcctgtccagcacccaccctacccccataaagcattgtttacacctg

SEQ ID NO: 17674 - DNA, 1015 bp, Homo sapiens
aggtagacagaaaagttctccaagtcctcaccggcccagaggcccagccatcttcacctctcaagctgtctgtagaggtccacgtgtcaagaaaactgaggacagaggccctcagtccagttcccacaagcaactgcatctccccaacagctgcctgaatgagtttggaagcagtcctcccaccattcagccttcagatgaaactgcacccctggctgacaggctgattgcagccttatagcagaccttaagcctgagacattcgacccacagaaaaggtgataattttggtctttttttttctaaacaggttcttgctctagagtgcagtggcacgatcatggctcactgcggcctctacatcctgggttcaagtggtcctcccacctcaacctcctgagtggctgggactacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccga

SEQ ID NO: 17675 - DNA, 4748 bp, Homo sapiens
atggactcagtacctgccactgtgccttctatcgccgctaccccgggggacccggaacttgtgggacccttgtctgtgctctacgcagccttcatagccaagctgctggagctagttgctacattgcctgatgatgttcagcctgggcctgatttttatggactgccatggaaacctgtatttatcactgccttcttgggaattgcttcgtttgccattttcttatggagaactgtccttgttgtgactgatacattggtttcagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacctgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccataaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatgggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacaca

SEQ ID NO: 17676 - DNA, 7946 bp, Homo sapiens
gaccacaacatggctgcggcgcctgggctgctcgtctggctgctcgtgctccggctgccctggcgggtgccgggccagctggaccccagcactggccggcggttctcggagcacaaactctgcgcggacgacgaatgcagcatgttaatgtaccgcggtgaggctcttgaagatttcacaggcccggattgtcgttttgtgaattttaaaaaaggtgatcctgtatatgtttactataaactggcaagaggatggcctgaagtttgggctggaagtgttggacgcacttttggatattttccaaaagatttaatccaggtagttcatgaatataccaaagaagagctacaagttccaacagatgagacggattttgtttgttttgatggaggaagagatgattttcataattataatgtagaagaacttttagggtttttggaactgtacaattctgcagctacagattctgagaaagctgtagaaaaaactttacaggatatggaaaaaaaccctgaattatctaaggaaagggaacctgaacctgaaccagtagaagccaactcagaggaaagtgatagtgtattctcagaaaacactgaggatcttcaggaacagtttacaactcagaagcaccactcccatgcaaacagccaagcaaatcatgctcagggagagcaggcttcatttgaatcttttgaagaaatgctgcaagataaactaaaagtgccagaaagtgaaaacaacaaaaccagcaatagttctcaggtctcaaatgaacaggataagattgatgcctataaacttttgaaaaaagaaatgactctagacttgaaaaccaaatttggctcaacagctgatgcacttgtatctgatgatgagacaaccagactcgttacttcattagaagatgattttgatgaggaattggatactgagtattatgcagttggaaaggaagatgaggagaaccaagaagactttgatgagttgccattacttacctttacagatggggaagatatgaaaactccagcaaagtctggcgttgagaaatatccaacagataaagagcagaattcaaatgaagaggacaaggttcagctaactgtgccccctggcatcaaaaatgatgataaaaatatactaacaacctggggggacactatcttctctattgtcacaggaggtgaagaaacaagagatacgatggatttagagagctctagttcagaggaagaaaaagaagatgatgatgatgcattagtcccagatagcaaacaggggaaaccacagtcagcaacagattatagtgaccctgacaatgtagatgatggtctttttattgtagacattcctaaaacaaataatgacaaagaagtaaacgcagaacatcacattaaaggaaaagggaggggagttcaggaatccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagcgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgagaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgagtaatacagtatattatgtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacctgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccataaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatgggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacaca

SEQ ID NO: 17677 - DNA, 2735 bp, Homo sapiens
gacgtgttttataggcggcataaagcgaaagtgcaggcagctgtggaaggcgaagttcaatcccagagtccgccccctgaattggggcctttccggaggaggaagctctgaaaaacagggggcccagtgccattccgcagggaattgtcgcttgcgttcagctgttctacacaatggactcagtacctgccactgtgccttctatcgccgctaccccgggggacccggaacttgtgggacccttgtctgtgctctacgcagccttcatagccaagctgctggagctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacctgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctag

SEQ ID NO: 17678 - DNA, 8123 bp, Homo sapiens
gaccacaacatggctgcggcgcctgggctgctcgtctggctgctcgtgctccggctgccctggcgggtgccgggccagctggaccccagcactggccggcggttctcggagcacaaactctgcgcggacgacgaatgcagcatgttaatgtaccgcggtgaggctcttgaagatttcacaggcccggattgtcgttttgtgaattttaaaaaaggtgatcctgtatatgtttactataaactggcaagaggatggcctgaagtttgggctggaagtgttggacgcacttttggatattttccaaaagatttaatccaggtagttcatgaatataccaaagaagagctacaagttccaacagatgagacggattttgtttgttttgatggaggaagagatgattttcataattataatgtagaagaacttttagggtttttggaactgtacaattctgcagctacagattctgagaaagctgtagaaaaaactttacaggatatggaaaaaaaccctgaattatctaaggaaagggaacctgaacctgaaccagtagaagccaactcagaggaaagtgatagtgtattctcagaaaacactgaggatcttcaggaacagtttacaactcagaagcaccactcccatgcaaacagccaagcaaatcatgctcagggagagcaggcttcatttgaatcttttgaagaaatgctgcaagataaactaaaagtgccagaaagtgaaaacaacaaaaccagcaatagttctcaggtctcaaatgaacaggataagattgatgcctataaacttttgaaaaaagaaatgactctagacttgaaaaccaaatttggctcaacagctgatgcacttgtatctgatgatgagacaaccagactcgttacttcattagaagatgattttgatgaggaattggatactgagtattatgcagttggaaaggaagatgaggagaaccaagaagactttgatgagttgccattacttacctttacagatggggaagatatgaaaactccagcaaagtctggcgttgagaaatatccaacagataaagagcagaattcaaatgaagaggacaaggttcagctaactgtgccccctggcatcaaaaatgatgataaaaatatactaacaacctggggggacactatcttctctattgtcacaggaggtgaagaaacaagagatacgatggatttagagagctctagttcagaggaagaaaaagaagatgatgatgatgcattagtcccagatagcaaacaggggaaaccacagtcagcaacagattatagtgaccctgacaatgtagatgatggtctttttattgtagacattcctaaaacaaataatgacaaagaagtaaacgcagaacatcacattaaaggaaaagggaggggagttcaggaatccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagcgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgagaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgagtaatacagtatattatgtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacctgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccataaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatgggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacaca

SEQ ID NO: 17679 - DNA, 2026 bp, Homo sapiens
aacatggctgcggcgcctgggctgctcgtctggctgctcgtgctccggctgccctggcgggtgccgggccagctggaccccagcactggccggcggttctcggagcacaaactctgcgcggacgacgaatgcagcatgttaatgtaccgcggtgaggctcttgaagatttcacaggcccggattgtcgttttgtgaattttaaaaaaggtgatcctgtatatgtttactataaactggcaagaggatggcctgaagtttgggctggaagtgttggacgcacttttggatattttccaaaagatttaatccaggtagttcatgaatataccaaagaagagctacaagttccaacagatgagacggattttgtttgttttgatggaggaagagatgattttcataattataatgtagaagaacttttagggtttttggaactgtacaattctgcagctacagattctgagaaagctgtagaaaaaactttacaggatatggaaaaaaaccctgaattatctaaggaaagggaacctgaacctgaaccagtagaagccaactcagaggaaagtgatagtgtattctcagaaaacactgaggatcttcaggaacagtttacaactcagaagcaccactcccatgcaaacagccaagcaaatcatgctcagggagagcaggcttcatttgaatcttttgaagaaatgctgcaagataaactaaaagtgccagaaagtgaaaacaacaaaaccagcaatagttctcaggtctcaaatgaacaggataagattgatgcctataaacttttgaaaaaagaaatgactctagacttgaaaaccaaatttggctcaacagctgatgcacttgtatctgatgatgagacaaccagactcgttacttcattagaagatgattttgatgaggaattggatactgagtattatgcagttggaaaggaagatgaggagaaccaagaagactttgatgagttgccattacttacctttacagatggggaagatatgaaaactccagcaaagtctggcgttgagaaatatccaacagataaagagcagaattcaaatgaagaggacaaggttcagctaactgtgccccctggcatcaaaaatgatgataaaaatatactaacaacctggggggacactatcttctctattgtcacaggaggtgaagaaacaagagatacgatggatttagagagctctagttcagaggaagaaaaagaagatgatgatgatgcattagtcccagatagcaaacaggggaaaccacagtcagcaacagattatagtgaccctgacaatgtagatgatggtctttttattgtagacattcctaaaacaaataatgacaaagaagtaaacgcagaacatcacattaaaggaaaagggaggggagttcaggaatccaagaggggcctggtacaagataagacagaattagaggatgaaaatcaagaaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatattt

SEQ ID NO: 17680 - DNA, 8142 bp, Homo sapiens
accggctccccgaggtgaccacaacatggctgcggcgcctgggctgctcgtctggctgctcgtgctccggctgccctggcgggtgccgggccagctggaccccagcactggccggcggttctcggagcacaaactctgcgcggacgacgaatgcagcatgttaatgtaccgcggtgaggctcttgaagatttcacaggcccggattgtcgttttgtgaattttaaaaaaggtgatcctgtatatgtttactataaactggcaagaggatggcctgaagtttgggctggaagtgttggacgcacttttggatattttccaaaagatttaatccaggtagttcatgaatataccaaagaagagctacaagttccaacagatgagacggattttgtttgttttgatggaggaagagatgattttcataattataatgtagaagaacttttagggtttttggaactgtacaattctgcagctacagattctgagaaagctgtagaaaaaactttacaggatatggaaaaaaaccctgaattatctaaggaaagggaacctgaacctgaaccagtagaagccaactcagaggaaagtgatagtgtattctcagaaaacactgaggatcttcaggaacagtttacaactcagaagcaccactcccatgcaaacagccaagcaaatcatgctcagggagagcaggcttcatttgaatcttttgaagaaatgctgcaagataaactaaaagtgccagaaagtgaaaacaacaaaaccagcaatagttctcaggtctcaaatgaacaggataagattgatgcctataaacttttgaaaaaagaaatgactctagacttgaaaaccaaatttggctcaacagctgatgcacttgtatctgatgatgagacaaccagactcgttacttcattagaagatgattttgatgaggaattggatactgagtattatgcagttggaaaggaagatgaggagaaccaagaagactttgatgagttgccattacttacctttacagatggggaagatatgaaaactccagcaaagtctggcgttgagaaatatccaacagataaagagcagaattcaaatgaagaggacaaggttcagctaactgtgccccctggcatcaaaaatgatgataaaaatatactaacaacctggggggacactatcttctctattgtcacaggaggtgaagaaacaagagatacgatggatttagagagctctagttcagaggaagaaaaagaagatgatgatgatgcattagtcccagatagcaaacaggggaaaccacagtcagcaacagattatagtgaccctgacaatgtagatgatggtctttttattgtagacattcctaaaacaaataatgacaaagaagtaaacgcagaacatcacattaaaggaaaagggaggggagttcaggaatccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagcgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgagaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacctgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccataaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatgggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacacagtg

SEQ ID NO: 17681 - DNA, 3045 bp, Homo sapiens
attagtcccagatagcaaacaggggaaaccacagtcagcaacagattatagtgaccctgacaatgtagatgatggtctttttattgtagacattcctaaaacaaataatgacaaagaagtaaacgcagaacatcacattaaaggaaaagggaggggagttcaggaatccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagcgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgagaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggt

SEQ ID NO: 17682 - DNA, 605 bp, Homo sapiens
gtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttgataaagatggcaggccaggcacagtggctcacgcctgtaatcccagcactttatgaatcccagcattcattagacgaggctgaggcaggtggatcccttgagcctaggagtttgagaccagcctgggcaacatggtgaaacccccatctctacaaaaaatccaaaaattagctgggagtggtggcgtgcacctgtagtcccagctactggggagtctgaggtgggaggattgattgagtccgggagattgaggctgcagtgagccatgatcactcattacactccagcccatgtgacaggcaagaccctgccgccaaaaaaaaaaaaaaaaaaaaaaaa

SEQ ID NO: 17683 - DNA, 3823 bp, Homo sapiens
atccagaggtgtccgcgctcccggagctgggcggagcggggcgcagcccacgtggttcgggcgggaggcgccgggacgtggccagttgcccgcctgccccggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaataattcttcaga

SEQ ID NO: 17684 - DNA, 2332 bp, Homo sapiens
agttgcccgcctgccccggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcacca

SEQ ID NO: 17685 - DNA, 744 bp, Homo sapiens
attgattcacaacacccttatgtgtaactcccattactattctcatcatggagaagagagaaaaaagtcagtagaagattcagtaacaggtccaagatgacacagcttgtgggccacactcctagttggaattccgactcttgcagttggtttgagcccacatgcttaacctcacacacacacacaccattcagaaagaatatagaagacaccattaataatgattgctttctggtcatggagataggaaaactgaattgcaaaagcggttcctggagaacagaatgtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggt

SEQ ID NO: 17686 - DNA, 565 bp, Homo sapiens
cattggaattcggaaggacaggcaggccgggcggactggagacggcggctcgccttgggaccctctgagcttgcgggccccgctgagcacccaaaggccggccctagagtccaggagaagagcgcagcggcgcggagctcccaggcgttccccgcagcgcgtcctcggtcctggaaccaccgcgccgcgcgtcctggcttccacatctgccccatttgcccgcggatcttgactttttcttggcgggcaaggcctcggtctcctccccgcagcagggctgcccgcggctgcgggaccctcctggtcctgatgcctggcagaatcgaaggggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccct

SEQ ID NO: 17687 - DNA, 2274 bp, Homo sapiens
cagttgcccgcctgccccggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccggctctttatgaggggactctgagcctctgctctgaggatctgaaacacacacaccctgacagtgtaaaatccaaaaggagccgcctgaatcatgttgcctcatgtggaaatccttagtccgccgccacgtgaagatggatgtgactagaacggagggcgcgggaggctcacatcagaggagctgctcacatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcatt

SEQ ID NO: 17688 - DNA, 971 bp, Homo sapiens
cggggcgtctcgtggacgcatgcgccccaaattgcgctcggggaattaaaagaggggaaaaaaagcccgaagaaaactcacgccccaaacaaaacgcaaggagaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgcgggtgcgagtgcttggaggagcgcgccctgcctgagaaggagcccctcgtcagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcacctgtggggggacctctcatgcagacttgcacatatgcagggagtattgcactga

SEQ ID NO: 17689 - DNA, 1314 bp, Homo sapiens
cggggcgtctcgtggacgcatgcgccccaaattgcgctcggggaattaaaagaggggaaaaaaagcccgaagaaaactcacgccccaaacaaaacgcaaggagaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgcgggtgcgagtgcttggaggagcgcgccctgcctgagaaggagcccctcgtcagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcactaccttccgtttccaagtccctaaaggagaggctcaggggcagaatgggaattcttccatgaggactcagcagtcaaccaaagttggacaattacatgtagaagagagtgagcaaatagagtttgcttagtgaaaaatgatactgaattctacataaatgtaaagtctttaatctgaggaccctgccccatgaattgtgcaggctgcattgaaacgccttggtgatctcatatttaggaagaaagttaaagagttggtcagatggatagttcataatgggtggttccattctgagagcccattgccccagctttggttttagttgtgtcataatctctgatcattaatcctactgactgagtggactatttcagttaataaaacaatatgattaata

SEQ ID NO: 17690 - DNA, 2183 bp, Homo sapiens
gaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgcgggtgcgagtgcttggaggagcgcgccctgcctgagaaggagcccctcgtcagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcactaccttccgtttccaagtccctaaaggagaggctcaggggcagaatgggaattcttccatgaggactcagcagtcaaccaaagttggacaattacatgtagaagagagtgagcaaatagagtttgcttagtgaaaaatgatactgaattctacataaatgtaaagtctttaatctgaggaccctgccccatgaattgtgcaggctgcattgaaacgccttggtgatctcatatttaggaagaaagttaaagagttggtcagatggatagttcataatgggtggttccattctgagagcccattgccccagctttggttttagttgtgtcataatctctgatcattaatcctactgactgagtggactatttcagttaataaaacaatatgattaatagagagagctgtcattgagtcccaaaatggattgccagttttaaaataattattataaaatgtatgctaaccccaaaataatactaggcatgaggtgacctctctgatttggtcaccttgtagaaccttggagggtgtcagggcatctctttgagtatcagttatgattattcagaagtatagatgtatcaaatgatagaaatgacaaggaatggctgggcgtggcgtgagtcaccgcgcccggccaagcccttggcattttatctggaatagcatctgtaaactgaagtgtttgacctctgttttcttctctcctctttcatctgtttctgattcgttggctggcagctgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaaaaatggaaatatttttatttttacagattttgcacttctgaattcaggttaaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaaca

SEQ ID NO: 17691 - DNA, 1289 bp, Homo sapiens
gggaatccaagcgggctcgcggcggacaccaggtgtcacctggccgtggcgtccggcgcggcgtgggcgtccgggggcgcggcgtggaggagcgcgcgggatggggcgtgggcgcggggagcgccgggcggagccttaacaagtggtcgggcgggcggacgaggcgggcgatggccccgcggccgggacgcgcacagggaccatgcagggcaacggcagcgcgctgcccaacgcctcccagcccgtgctccgcggggacggcgcgcggccctcgtggctggcgtccgccctggcctgcgtcctcatcttcaccatcgtggtggacatcctgggcaacctcctggtcatcctgtcggtgtatcggaacaagaagctcaggaacgcaggaaacatctttgtggtgagcttagcggtggcagacctggtggtggccatttatccgtacccgttggtgctgatgtcgatatttaacaacgggtggaacctgggctatctgcactgccaagtcagtgggttcctgatgggcctgagcgtcatcggctccatattcaacatcaccggcatcgccatcaaccgctactgctacatctgccacagtctcaagtacgacaaactgtacagcagcaagaactccctctgctacgtgctcctcatatggctcctgacgctggcggccgtcctgcccaacctccgtgcagggactctccagtacgacccgaggatctactcgtgcaccttcgcccagtccgtcagctccgcctacaccatcgccgtggtggttttccacttcctcgtccccatgatcatagtcatcttctgttacctgagaatatggatcctggttctccaggtcagacagagggtgaaacctgaccgcaaacccaaactgaaaccacaggacttcaggaattttgtcaccatgtttgtggtttttgtcctttttgccatttgctgggctcctctgaacttcattggcctggccgtggcctctgaccccgccagcatggtgcctaggatcccagagtggctgtttgtggccagttactacatggcgtatttcaacagctgcctcaatgccattatatacgggctactgaaccaaaatttcaggaaggaatacaggagaattatagtctcgctctgtacagccagggtgttctttgtggacagctctaacgacgtggccgatagggttaaatggaaaccgtctccactgatgaccaacaataatgtagtaaaggtggactccgtttaaaaaagcaccacgttccgggtgagatggacacgct

SEQ ID NO: 17692 - DNA, 1565 bp, Homo sapiens
tctgcgatgtcagagaacggctccttcgccaactgctgcgaggcgggcgggtgggcagtgcgcccgggctggtcgggggctggcagcgcgcggccctccaggacccctcgacctccctgggtggctccagcgctgtccgcggtgctcatcgtcaccaccgccgtggacgtcgtgggcaacctcctggtgatcctctccgtgctcaggaaccgcaagctccggaacgcaggtaatttgttcttggtgagtctggcattggctgacctggtggtggccttctacccctacccgctaatcctcgtggccatcttctatgacggctgggccctgggggaggagcactgcaaggccagcgcctttgtgatgggcctgagcgtcatcggctctgtcttcaatatcactgccatcgccattaaccgctactgctacatctgccacagcatggcctaccaccgaatctaccggcgctggcacacccctctgcacatctgcctcatctggctcctcaccgtggtggccttgctgcccaacttctttgtggggtccctggagtacgacccacgcatctattcctgcaccttcatccagaccgccagcacccagtacacggcggcagtggtggtcatccacttcctcctccctatcgctgtcgtgtccttctgctacctgcgcatctgggtgctggtgcttcaggcccgcaggaaagccaagccagagagcaggctgtgcctgaagcccagcgacttgcggagctttctaaccatgtttgtggtgtttgtgatctttgccatctgctgggctccacttaactgcatcggcctcgctgtggccatcaacccccaagaaatggctccccagatccctgaggggctatttgtcactagctacttactggcttatttcaacagctgcctgaatgccattgtctatgggctcttgaaccaaaacttccgcagggaatacaagaggatcctcttggccctttggaacccacggcactgcattcaagatgcttccaagggcagccacgcggaggggctgcagagcccagctccacccatcattggtgtgcagcaccaggcagatgctctctagcctggatctgaggcacaccagcagcatgacaaactcatgaaatggtgggagagagtctgctgcaagggtgagaccaggcagcctgctgggccacactgtcctgttggcatcacagccccaaggctgggggaacttcatgctgggacaagcagcccatcaacgccatgggttcaggctgatccaggagatgctcacaggccacaggacctggaaaacactcttggtggtgtcttggggatttggtgcacacaagaccaaggaaaggacagaatgaggaaaggcctggggcagaagagcccaactccttctcatagctgaccctcatcctcctgccttggcctcctggctgctttctccccttccccccagcgtggcaggatctcttcctgttagcaaggatgaaagagagaggtcagtaggactggaacttggtaactgcaagggcctcaggtggggcaggtgcagagggc

SEQ ID NO: 17693 - DNA, 4562 bp, Homo sapiens
atgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgcgatgatacctcctaatatcgctgcatgtatgagaaatgaaaagctcggggaggcttgcttctaccttatgggccataatcaaactacgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctga

SEQ ID NO: 17694 - DNA, 4389 bp, Homo sapiens
atgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacttccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctga

SEQ ID NO: 17695 - DNA, 4250 bp, Homo sapiens
ggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgcgatgatacctcctaatatcgctgcatgtatgagaaatgaaaagctcggggaggcttgcttctaccttatgggccataatcaaactacgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctga

SEQ ID NO: 17696 - DNA, 4791 bp, Homo sapiens
cggaatgcaaacaaagctcgcgggcgcctgtgcggggctcgcggggaagcccagaaagtttgttttatgatggcttgagtgcgcgagcgtgtgcaggggagcgaggctgccaagtttctctctcctgttttgtgatttggggagagatgtttctcccatgaacaagcggaggcttgggggctcgtgctgtggggggcacctgtctctcgttttatttttttggaggaggggtgtaactcatcatgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttgcaggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatggtgggtcaaactatgaaaacattccttccttccctggcatgactccatgaatttgtctccagaacggcagcaggaaagtcttttttgtttcccctattcaccagtgtcttaccagcctctcgcaccatgtgattatttgcctcgcttgttctgaaatctctacacatttcatccttttgcttgcttacgtggactggggcatggcctaagacaagatctttatagccccctttctgataatcagagagaacgttttgtctagtccgaccaagagcgaaggaatgtttgtttgtactgtgccaaactgttcctcagatccaattgttagcacaaaatgactatatactccttttaagaagcaggaaagcaggtttcctgagtgatatgttgaggcacaattattttttcctttttggttacttggtgtctttatttaagaggcatgaaattttgagagatttgggggctttgctaacctcccttatgctctgtatacaacacttctccatcccccaactggtgtcttaccccaaatcagaccatctgagcccactactatcaaacaaacaaacaaaaactgttaatatattagccataatgtttttaaatgataaaggatgaaataaattcccagtgctcatcatgagggaaacatgtgactatacctttcctatgaggaaagccaggttatacatagagttcctttgtcatatctttagacttgatttgagtagacagcaatgatctttacatagcttagtgttctgatggcaaaatattgtatatgataataattatgtcctatttatttgagatttgtgtttaaaa

SEQ ID NO: 17697 - DNA, 1794 bp, Homo sapiens
gagagtttgcgccggttcgcattccccggcctcccgttcgctcccccgcgaaccaggcggccgtgcgcctctcggggcaaccacccaagagcacccgggcgggaggacgccgagcagggggtgttgcgggctgggacaggggcagccacctcccgaagatgcaggatggcagcagagccgcagccgtccagcctttcctaccgcaccacgggctccacctacctgcacccgctcagcgagctcctgggcatcccgctggaccaggtgaattttgtggtatgccagcttgttgctctgtttgctgctttctggtttcgcatctacttacgtcctggtacaaccagctctgatgtccggcatgcggttgccaccatttttggcatctattttgtcatcttttgtttcggctggtactctgtgcatctttttgtgctggtgttaatgtgctatgcaatcatggtcactgctagtgtatccaatattcacagatattccttttttgtagcaatgggatatcttacaatatgccacatcagccgaatatacatcttccactatggaattctcactacggatttttctgggcctctgatgattgtcactcagaagatcacaaccttggcattccaggttcatgatggattaggtcgaagagctgaagacctttctgctgaacaacatcgacttgctatcaaagtgaaaccctcttttttggaatacttaagttaccttctcaatttcatgagtgtcatagctggtccttgtaacaatttcaaggactacatagccttcattgaggggaagcatatacacatgaagttgctggaggtgaactggaagcgaaaaggtttccacagcttgccagaaccttctcccacaggagctgtgatacacaagttgggcatcaccttggtgtctctccttttgtttttgacgctaacgaagacctttcctgtcacctgccttgtggatgactggtttgtccataaagcaagctttccggctcgactctgctacttatatgttgtcatgcaagcctcaaagcccaagtattactttgcatggacattagctgatgcagtgaataacgcagctggctttgggttcagcggagtggataagaatgggaatttctgttgggatctgctttcgaacctaaacatctggaaaattgagactgccacaagtttcaaaatgtacttggaaaactggaatattcagacagctacttggctaaagtgtgtgtgctatcagcgggttccatggtaccccacggtgctaaccttcatcctgtctgctttgtggcatggtgtctaccctggatactattttaccttcttaactggaattcttgtcacattagcagctagagcggtcaggaacaactacagacattacttcctttcttcaagagctctcaaggctgtgtatgatgcaggcacctgggccgtcactcagctggctgtctcttacacggtagcaccctttgtgatgttggcagttgaaccgaccatcagcttatacaagtccatgtacttttatttgcacatcataagtctcctgataatactatttctgccaatgaaaccacaagctcatacgcaaaggcggcctcagactctgaactctattaataagagaaaaacagattgatacctccaagagaagcggaacaagcaaaactgcagaacgttcgaaagatgagatgacaaggcttcaagggctcctccggtggcttagaggcgatgtttacatgcatctttattttgttcttttttaaagtgcagggagtat

SEQ ID NO: 17698 - DNA, 931 bp, Homo sapiens
agcgccaaagccaagtttgcgcctcgagagtttgcgcctcgagagtttgcgccggttcgcattccccggcctcccgttcgctcccccgcgaaccaggcggccgtgcgcctctcggggcaaccacccaagagcacccgggcgggaggacgccgagcagggggtgttgcgggctgggacaggggcagccacctcccgaagatgcaggatggcagcagagccgcagccgtccagcctttcctaccgcaccacgggctccacctacctgcacccgctcagcgagctcctgggcatcccgctggaccaggtgaattttgtggtatgccagcttgttgctctgtttgctgctttctggtttcgcatctacttacgtcctggtacaaccagctctgatgtccggcatgcggttgccaccatttttggcatctattttgtcatcttttgtttcggctggtactctgtgcatctttttgtgctggtgttaatgtgctatgcaatcatggtcactgctagtgtatccaatattcacagatattccttttttgtagcaatgggatatcttacaatatgccacatcagccgaatatacatcttccactatggaattctcactacggatttttctgggcctctgatgattgtcactcagaagatcacaaccttggcattccaggttcatgatggattaggtcgaagagctgaagacctttctgctgaacaacatcgacttgctatcaaagtgaaaccctcttttttggaatacttaagttaccttctcaatttcatgagtgtcatagctggtccttgtaacaatttcaaggactacatagccttcattgaggggaagcatatacacatgaagttgctggaggtgaactggaagcgaaaaggtttccacagcttgccagaaccttctcccacaggacatttgtaa

SEQ ID NO: 17699 - DNA, 3219 bp, Homo sapiens
agcgccaaagccaagtttgcgcctcgagagtttgcgcctcgagagtttgcgccggttcgcattccccggcctcccgttcgctcccccgcgaaccaggcggccgtgcgcctctcggggcaaccacccaagagcacccgggcgggaggacgccgagcagggggtgttgcgggctgggacaggggcagccacctcccgaagatgcaggatggcagcagagccgcagccgtccagcctttcctaccgcaccacgggctccacctacctgcacccgctcagcgagctcctgggcatcccgctggaccaggtgaattttgtggtatgccagcttgttgctctgtttgctgctttctggtttcgcatctacttacgtcctggtacaaccagctctgatgtccggcatgcggttgccaccatttttggcatctattttgtcatcttttgtttcggctggtactctgtgcatctttttgtgctggtgttaatgtgctatgcaatcatggtcactgctagtgtatccaatattcacagatattccttttttgtagcaatgggatatcttacaatatgccacatcagccgaatatacatcttccactatggaattctcactacggatttttctgggattaggtcgaagagctgaagacctttctgctgaacaacatcgacttgctatcaaagtgaaaccctcttttttggaatacttaagttaccttctcaatttcatgagtgtcatagctggtccttgtaacaatttcaaggactacatagccttcattgaggggaagcatatacacatgaagttgctggaggtgaactggaagcgaaaaggtttccacagcttgccagaaccttctcccacaggagctgtgatacacaagttgggcatcaccttggtgtctctccttttgtttttgacgctaacgaagacctttcctgtcacctgccttgtggatgactggtttgtccataaagcaagctttccggctcgactctgctacttatatgttgtcatgcaagcctcaaagcccaagtattactttgcatggacattagctgatgcagtgaataacgcagctggctttgggttcagcggagtggataagaatgggaatttctgttgggatctgctttcgaacctaaacatctggaaaattgagactgccacaagtttcaaaatgtacttggaaaactggaatattcagacagctacttggctaaagtgtgtgtgctatcagcgggttccatggtaccccacggtgctaaccttcatcctgtctgctttgtggcatggtgtctaccctggatactattttaccttcttaactggaattcttgtcacattagcagctagagcggtcaggaacaactacagacattacttcctttcttcaagagctctcaaggctgtgtatgatgcaggcacctgggccgtcactcagctggctgtctcttacacggtagcaccctttgtgatgttggcagttgaaccgaccatcagcttatacaagtccatgtacttttatttgcacatcataagtctcctgataatactatttctgccaatgaaaccacaagctcatacgcaaaggcggcctcagactctgaactctattaataagagaaaaacagattgatacctccaagagaagcggaacaagcaaaactgcagaacgttcgaaagatgagatgacaaggcttcaagggctcctccggtggcttagaggcgatgtttacatgcatctttattttgttcttttttaaagtgcagggagtatttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgggagtatttttataaagcctttttgtacagattaatcggccatgtccaggttattggttttgatattttataggacatttgagtggtgtggcgatgtgtagagaatgtgccagagctgcagagacagtccattctgggctgctggctttttgcccttcctgcatgatttccagctactgtgacctggatgctgggaacccaggcatcggctccaaaaattagaaggcgagtgctgagaagacttgtcacaggtttctcaaatcagaatatactcagtcatagtggttccctgggaagccccagaccctttgacttgtgacattactggtttgcagacataataactacactcagaggaccatggaggcagagggatcatggtttcagggcactgaaaactctacgagccaagaggactagtgcatggactgaaagtcaggcatgccctcaaataggctgtattttctttccaggaatgtaacctttcccctttttcttctgacctgagccaagattggaaatcagaaagtctcctgtacatggagctgaagaggggctgctgttttccgaatgttttccatttcacaggcgccacctgcttgcccggggttggtcttgagaagacacccaaatgttcatgcctcagaaaggcagcagaatgccttttaggaaatttttttaaagtaatttgaagttatatagaagtttggtaagaagaagcagttgtttctctcttttctccctcatttcatggaggtgttaatgatcatggctggccgtgatgtacacatgggctgattttcattttttcagtttcatagctgagaaattcagctttgttttagttgaatcatcatattggaaagcagacattgaaagttttcttttctatctttgttatgaatgtgctatggccccttttggagacttctattgggtaatattctatgtgagagaaggaaacttggtattaaatgttgtggaaaataataatgatgataataataaagtatatgctgcaatggtgtactgccaatcagattgcttgggagaagaaaatttattcaaatccaacgataaaaaattaatttcttattgaataaacagtatgttcccatataaaagaaat

SEQ ID NO: 17700 - DNA, 7751 bp, Homo sapiens
cgggcgcgggaggaggtggcggcggagggggaggtgcgagccgggcaccgcccccggcccctccccggccttccccgcgcagagctccgaccgcgggcggcccaggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccaggtcaactttgtagtgtgccaactctttgccttgctagcagccatttggtttcgaacttatctacattcaagcaaaactagctcttttataagacatgtagttgctacccttttgggcctttatcttgcacttttttgctttggatggtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtctccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaaaaaaagaaaaaagaaattatgccagctgtttaatgtgagagaatagaaagaatgttcatggaatgtacctgccctgtaaaatgtttgatcattttcattaatgttgcagagaatccgactgctattaagagaaagtgaacaaattaagaatttaaaagacaggttcaggcatgtcataagtgaaaacaagaaggcttaatacaaacttgttgggttttgttcgtgtgtgtgtgtgtgtgtgtgtgtgtgtttttttttggttcagcctatctagccacctacaaataatcacatttctgttacctgaatttatttctcagcctgtaaaccttagtcactgttacctgtttcttgctcagtgaatatgatcttggcactgtcatctagaaagcaagatatttgattggttttctggttccttcgaagataataattccatatccagtttgactgattttcatacccctgaatcaactagttattttcatgaaatggtttttggatatctctcctctagtttggagaagtaataatcacaaagattaatattttgcttctagtacttacagtagaagaattttaaactggtacgtctactcctgttaaatagaaaggggattcgttgtattatgtgcttgcttttttttaatcaatagaataagattcaatgcatatttatgttttatattttccactattcaggtatcatgaaatcactctagagatgatcaatcaacatcatatttatacttttggttaattatatactactcagggaaaaaatgaacaaaaataactactcatccttcaatttcattttcttgaaacagtaagagtataatttggtatgcctcagctgtcaccattttataagtggctcattctgttcttaaagtaagtatttttattggaactcagggtaattgggggaatttatttagcttctaaaatatccggcaggatagagaagatttatttggcttcaaaaatgtctggtgaccacttctcttattagccactactgcccatttgcttcaaaaatatatttattggtctccaccatgtgtgacacacacaggatttccaaacataccacttttgagaaaaatgtgcagtaaaaaggaggtttctagaaagtgacagtaactcacatttaagcactagctgacctaggaggagacctggatcttcattctggttctgcctttcatgagacttaagacttggaggagccacctgtcctgtagaccccaagttcctcagccataagcaaacgggttaatcctaagagttcaggaccagttgggtgtcgtgaacggagccattagcaaggtctgtaggattcaaggacttgggcacattcacagtccacactattgtcatggtcattgacttactacttgagctcaaagccctgacatttcaaaaggttgtcatgataacagtgaaacctctgaatcccttaaatcagaaggcatggcaacatactttttctactggcaatagctcttacaatgagtgtttcataatgaaatagtctctgctgaagaaaacatgttttccttttgctctctctgctttgttggtttctgtgctgtgtggaattggagaagatatatgctctgaaatattttatacagattactgactactggacagggtttaccactatataacatctcaaagttattcaaggatatttaaagcatatttagtttagttacaccttattttaaaccgcagaaaacaatagctttaaaatttttgccattaaaataattataaatttatacttttactcaaggactagatcacagttttaggacaaaaatctctcctatttaaagttcataccttgtaagtatttagtttgtatattcatgaacaaatctggacatttatactttttttgtttccttatcaactgttcacaattattagttaattggtcttaacagttctacattataattgaaagaaaaattacttgagaaaataattgtttcagaatagtgcctactatatctgtgtcagctaaaaatttgtccagagttttagatataagctagtattttgtggagttttatccaggcgttaatagttcttcctggctgaaatttaatataggtgcagaatcctaaataacactgtgagatgtaatcttaactgccctcaataccttataaaactgctgcatttaacccagtgtgcatttaatgagtggctggtcgttgatacactcatcttagatgctgaaatttctgttttctccagcccttgtaaaagtgggtttcttgatgaacgcgtgctcccaatgctgaagcaaaagatttgcatttaaggagagaaatacaccctgaaatttgagtttgaaagattagaacatagagggtctctacagtgtttttctgcaacaccaagtagtcaaatctatttatagaaactctgattacaacagaaattttaaaatgaaattttccacatcggtattttgtaggaaagctcttataatcaatgcttaagctgctttttgaggcttttcttgtacagaggttgcagccaattacattttaattggtaggctgctgaataatgtttttgtatgttttaaaataatatttattttaataggttttttaacattatgcaaatcccaataaagaactgacacgttccataggccattgactgggaaattttgtgaaacacagcctaaatacacagtttttacaccaactaatttgtcttgcctttaaaactgattataactcttctttaagtacaacttttataaagaaaaaatacaacactaagactgtatgttctgtaaattatagtgtgatgacccatgcagaaccgctgtctgaagcttactcagcgattcatagccatctccagccatgttttatcaaatcacacactaaaaataaatggaaatgctacagtgaaaaaccaaaagttacagagcaacataagtaaaatgactaggcagtttcttagtaacatgtttgaaatgggaaaggtgactgactgcctttcaccagagtcttagctgtttcacgttcactattttaggttaattttcttgggaaatcaatttgaatattcccccctgtccttttgcattaaaggacgaaaatatatgttgagagtttgacagactttttaaatatgcctctttcccaattttatgtatttttggttctgcgcacacagatttatcaatgaagtacatttgcctctggctttatcacaaggaaaaaggaatcaaacattgaacacaaatgtgttccaaaccagtcttgtccatcttgtcacttttatgtgactgctcctctgaaccagaaggggcacgatagaaggccataggaatgaaagtaaatcattcaggtgaagtgagaaattcttccatatacagagtgaaaatgtgtgatttcattcctgccttcctttaaacgttgtcttgatctctgcctagtagtagttgagccctcagtcgcccaaacatgaggagagacccaactccagcagccagaatttagtatttacatttgccttcccaagttgagaatagaatgtggtgttctgtgctttctgtttttattattccaaaatatttttttaaagaagtgttatttttcaacagattcataaattagttcctgatgtacggtaaattaaaactcccactgtgtcagtcaaactgagatgtgctcatttcataaccactcatttctagtctgtcagagctgcactggtggcttattgctggtttttaaaggtgtttttaacttacatgtaacatgtttaggacatgttttttttttctaatttgtgtgtctttacaactgattaaacagtagtttaaaaata

SEQ ID NO: 17701 - DNA, 1512 bp, Homo sapiens
agagacagcctggttgagattactcttggaggaaggcatcagttaaggacactggaaaagacaggctcttttgttctggttcctaatggagtggctttggctgttctttctccatcctatatcgttttaccagggggctgcatttccctttgcacttctcttcaattatctctgcatcatggattcattctccactcgtgccaggtacctctttctcctgactggaggaggtgccctggccgtggctgccatgggttcctacgccgtgctcgtcttcacccctgctgtctgcgctgtggctctcctctgttccctggctcctcagcaagtccacaggtggaccttctgctttcagatgagctggcagaccttgtgtcacctaggtctgcactacactgagtattatctgcatgagcctccttctgtgaggttctgcatcactctttcttctctcatgctcttgacccagagggtcacgtccctctctctggacatttgtgaggggaaagtgaaggcagcatctggaggcttcaggagcaggagctctttgtctgagcatgtgtgtaaggcactgccctatttcagctacttgctctttttccctgctctcctgggaggctctctgtgctccttccagcgatttcaggctcgtgttcaagggtccagtgctttgcatcccagacactctttctgggctctgagctggaggggtctgcagattcttggactagaatgcctaaacgtggcagtgagcagggtggtggatgcaggagcgggactgactgattgccagcaattcgagtgcatctatgtcgtgtggaccacagctgggcttttcaagctcacctactactcccactggatcctggacgactccctcctccacgcagcgggctttgggcctgagcttggtcagagccctggagaggagggatatgtccccgatgcagacatctggaccctggaaagaacccacaggatatctgtgttctcaagaaagtggaaccaaagcacagctcgatggctccgacggcttgtattccagcacagcagggcttggccgttgttgcagacatttgccttctctgcctggtggcatggactccatccaggacaggtgtttggtttcgtttgctgggccgtgatggtggaagctgactacctgattcactcctttgccaatgagtttatcagatcctggccgatgaggctgttctatagaaccctcacctgggcccacacccagttgatcattgcctacatcatgctggctgtggaggtcaggagtctctcctctctctggttgctctgtaattcgtacaacagtgtctttcccatggtgtactgtattctgcttttgctattggcgaagagaaagcacaaatgtaactgacatctttccctggctttcaccttaaacacccaggaaacattttagaaagtgccagatgacgcatcgataatgcatacatttgaacttttccataataaaattttttctaaagttttgga

SEQ ID NO: 17702 - DNA, 1389 bp, Homo sapiens
ttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcacgctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccact

SEQ ID NO: 17703 - DNA, 2042 bp, Homo sapiens
gtccgcgccctcccggcgcaccgcctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcacgctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 17704 - DNA, 2195 bp, Homo sapiens
agctccgtccgcgccctcccggcgcaccgcctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagagcttcctttgagcaactgcctctgccctttgaaccctgctgcagatgtttcctctgaaggggctttcagagcggcaggcattgccactccagcactttgtctgattaaaggccagaggctgcagaacaaaggccagacatggagtcctgggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcacgctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgcc

SEQ ID NO: 17705 - DNA, 4414 bp, Homo sapiens
cttcccagtgggactccagcagggcgtcgtggtctgtgcggtgtctcccaaaccactacctggctgcccccgtaccagctgctgggaaagactacttcctccgagttgtgccggcctccgcgttctcctcacctcccctctcctccggacctccgccccctcgcggagaggccttgccgctttaagagccgggctagcgattgacaagcaataaacgctgagcgcccggctgcgctggagccgcccggagctaggggcttcccggggcgcaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcacgtggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagctagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtatgtgtgtgcgtgtgcacgtgcgtgtgtgtgtgtgtgtgtcaggtttaatttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaatgttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagctgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagcaaaggc

SEQ ID NO: 17706 - DNA, 3462 bp, Homo sapiens
gagcgcccggctgcgctggagccgcccggagctaggggcttcccggggcgcaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggtgataatggtattgtggtttatgcagcagaatgtctttgttcctatgaaatacatgctgaaatactttggggcccatgagaggctggaggagacgaagctggaggccgtgagagacaacaacctggagctggtgcaggagatcctgcgggacctggcgcacgtggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagctagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtatgtgtgtgcgtgtgcacgtgcgtgtgtgtgtgtgtgtgtcaggtttaatttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaa

SEQ ID NO: 17707 - DNA, 543 bp, Homo sapiens
aggcgtcccccggcccccgggccagctcctatcccaagacctccgccttcttttcgtcctgacacggcacttaggaccctattcactgggtttaaactccacaggcccctttcacccaggcccgttccctccctgtccacccgcccccgcccctgggccctctttctggggtgctggttgggagaaccaagccccgctgcccattgacactggtccccgcccctgcggtaggggctccaaagtggcttcaggcaccaaggtggtgagctgtgaggggccccggtatctgcgcggcctccccgggggctgtgcgggttgggggtacttagaagcccggcattacggaaggaggacttctggagtcccttctctgaccctgtgagggagagcagcgccagccaggagaaggctccaggagagacgtttcagagcccttgcctccttcaccatgccggttgccgccaccaactctgaaactgccatgcagcaagtcctggacaacttgggatccctccccagtgccacgggggctgcagagctgga

SEQ ID NO: 17708 - DNA, 741 bp, Homo sapiens
gtcccccggcccccgggccagctcctatcccaagacctccgccttcttttcgtcctgacacggcacttaggaccctattcactgggtttaaactccacaggcccctttcacccaggcccgttccctccctgtccacccgcccccgcccctgggccctctttctggggtgctggttgggagaaccaagccccgctgcccattgacactggtccccgcccctgcggtaggggctccaaagtggcttcaggcaccaaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcacgtggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctg

SEQ ID NO: 17709 - DNA, 545 bp, Homo sapiens
ataaacgctgagcgcccggctgcgctggagccgcccggagctaggggcttcccggggcgcagggaaggaggacttctggagtcccttctctgaccctgtgagggagagcagcgccagccaggagaaggctccaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcacgtggctgagcagagcagcacagccgccgagctggcccacatcctccaggagccccacttccagtccctcctggagacgcacgactctgtggcctcaaagacctatgagacaccaccccccagccctggcctggaccct

SEQ ID NO: 17710 - DNA, 588 bp, Homo sapiens
aggtaggcgtcccccggcccccgggccagctcctatcccaagacctccgccttcttttcgtcctgacacggcacttaggaccctattcactgggtttaaactccacaggcccctttcacccaggcccgttccctccctgtccacccgcccccgcccctgggccctctttctggggtgctggttgggagaaccaagccccgctgcccattgacactggtccccgcccctgcggtaggggctccaaagtggcttcaggcaccaagggaaggaggacttctggagtcccttctctgaccctgtgagggagagcagcgccagccaggagaaggctccaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggaga

SEQ ID NO: 17711 - DNA, 584 bp, Homo sapiens
aaagtggcttcaggcaccaaggtggtgagctgtgaggggccccggtatctgcgcggcctccccgggggctgtgcgggttgggggtacttagaagcccggcattacgagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcacgtggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggaga

SEQ ID NO: 17712 - DNA, 2275 bp, Homo sapiens
gacctggtgccactcctcagggaatgtctgagtggaggctgcagtaccctgatggtggcctcttgggcacaagatctcagaggaatggggtcaccggagcggagctgagtccttcccttctgcccacacttttccctgtgtgcaaatgtgccctcatttttcctttctggggaactgagttccaagatgcctgacttgcttcctgggcatcatccccttcattaagaggaagaactcatgggagatgggggaggggaagaagctgctgtgaggcgagggccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcacgtggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccct

SEQ ID NO: 17713 - DNA, 1434 bp, Homo sapiens
actcgcgcggctcccgttcgcggagcacacatcccggcgcgacgaggttccttcggagagcgagcgggagtcggtgctcggcctcctgcggggagcagcccgaggcctggtctcagagaacacagtagatgtgtagtcagtttgttcaataaatatgcttgatggagcttcaatacccacctccacccccttctcccagaatctgcagggagaggtcgggaggtgacaacgccagcatgccagtgctatcggaggactctggtttgcatgaaaccctggccctgctgacctcccagctcagacctgactccaaccacaaggaggagatgggcttcctgagggatgttttcagtgaaaaaagcctcagttacttaatgaagattcatgagaagcttcgctattatgaaaggcaaagtccaaccccagttctgcacagcgctgtggccctcgctgaggacgtgatggaggagttgcaggccgcctccgtgcacagtgatgagagggagctgctccagctgctgtccaccccgcacctgagggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctgggtgccaccatccggcgggacgagcactcaggggctgttgtggtggccaggatcatgcgaggaggcgcagcagacaggagcggcctggtccacgttggagatgagctccgagaagtgaacgggatcgcagtcctgcacaagcggcccgacgagatcagccagattctggcccagtcccagggatccatcaccctaaaaatcatcccagccacccaggaggaagatcgcttaaaggagagcaaggtgttcatgcgcgccctcttccactacaaccctcgggaggaccgggccatcccttgccaggaggcgggcctgcccttccagcgcaggcaggtcctggaggtggtgagccaggacgaccccacgtggtggcaggccaagcgagtcggggacaccaaccttcgagccggcctcatcccctccaaggggttccaggagagacgactaagctaccggagagcctatgggacccccatctctcctcagttctctcaacccaagcaggagctgagcctgcccaggcattgggcccccacccagcttttacccagctgtggggcacactgccctggcgggaaaggcacacacacccctacattaataccaattctattatcaccatcattgcaattggagtttattcaatattaacaccactaccacgcagtgaggggtgtttgcggctctccagagccccttttcacttgttttggtcagttttttcaaaggtcttagagataggcaaaaagtttttttt

SEQ ID NO: 17714 - DNA, 2182 bp, Homo sapiens
ccagcggcggcccaggctctgggcactcgcgcggctcccgttcgcggagcacacatcccggcgcgacgaggttccttcggagagcgagcgggagtcggtgctcggcctcctgcggggagcagcccgaggaatctgcagggagaggtcgggaggtgacaacgccagcatgccagtgctatcggaggactctggtttgcatgaaaccctggccctgctgacctcccagctcagacctgactccaaccacaaggaggagatgggcttcctgagggatgttttcagtgaaaaaagcctcagttacttaatgaagattcatgagaagcttcgctattatgaaaggcaaagtccaaccccagttctgcacagcgctgtggccctcgctgaggacgtgatggaggagttgcaggccgcctccgtgcacagtgatgagagggagctgctccagctgctgtccaccccgcacctgagggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctgggtgccaccatccggcgggacgagcactcaggggctgttgtggtggccaggatcatgcgaggaggcgcagcagacaggagcggcctggtccacgttggagatgagctccgagaagtgaacgggatcgcagtcctgcacaagcggcccgacgagatcagccagattctggcccagtcccagggatccatcaccctaaaaatcatcccagccacccaggaggaagatcgcttaaaggagagcaaggtgttcatgcgcgccctcttccactacaaccctcgggaggaccgggccatcccttgccaggaggcgggcctgcccttccagcgcaggcaggtcctggaggtggtgagccaggacgaccccacgtggtggcaggccaagcgagtcggggacaccaaccttcgagccggcctcatcccctccaaggggttccaggagagacgactaagctaccggagagccgcgggcaccctgccgagcccccagagcctcaggaagcccccctatgatcagccttgtgacaaagagacctgtgactgtgagggctacctcaaagggcactatgtggctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccacataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaa

SEQ ID NO: 17715 - DNA, 2996 bp, Homo sapiens
agcttccacgccgctgtttcttcatcaataaaatgggaacattcgcagtcatttctcaggactttgtgcagacaaaaagtttatcatagaaatcaccccacacaatgcttggcacatcgaggacactcagcacatcttagctttatttccttcctctctgaaaaaagtaagcagagttatttgttcccatcctctctgtccacagcctggtctcagagaacacagtagatgtgtagtcagtttgttcaataaatatgcttgatggagcttcaatacccacctccacccccttctcccagaatctgcagggagaggtcgggaggtgacaacgccagcatgccagtgctatcggaggactctggtttgcatgaaaccctggccctgctgacctcccagctcagacctgactccaaccacaaggaggagatgggcttcctgagggatgttttcagtgaaaaaagcctcagttacttaatgaagattcatgagaagcttcgctattatgaaaggcaaagtccaaccccagttctgcacagcgctgtggccctcgctgaggacgtgatggaggagttgcaggccgcctccgtgcacagtgatgagagggagctgctccagctgctgtccaccccgcacctgagggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctgggtgccaccatccggcgggacgagcactcaggggctgttgtggtggccaggatcatgcgaggaggcgcagcagacaggagcggcctggtccacgttggagatgagctccgagaagtgaacgggatcgcagtcctgcacaagcggcccgacgagatcagccagattctggcccagtcccagggatccatcaccctaaaaatcatcccagccacccaggaggaagatcgcttaaaggagagcaaggtgttcatgcgcgccctcttccactacaaccctcgggaggaccgggccatcccttgccaggaggcgggcctgcccttccagcgcaggcaggtcctggaggtggtgagccaggacgaccccacgtggtggcaggccaagcgagtcggggacaccaaccttcgagccggcctcatcccctccaaggggttccaggagagacgactaagctaccggagagccgcgggcaccctgccgagcccccagagcctcaggaagcccccctatgatcagccttgtgacaaagagacctgtgactgtgagggctacctcaaagggcactatgtggctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccacataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaagctgaccctgattctttgtaccaaagttaagtagccactgtcttttgtgggtggtagtggttaatttatacagtactgattcgcagaatgtttaagctttttaaacatagtgacgcttagtagtttttttggaagctaacttgttttatccaaggggattttacatgtaactgaagttcccctgtcttcaagcactaaaacgttgatcttaaccttttttttgaagtgcttgcctggtaatagaaaacgggttctctgcctattttaaaatagtgaatatacgtaaattttctctggaaggctgaggcacacttcaccatcaacatgaattactgtactatcctgtactgcagtggtgccttcagggactcgaggaatgtaaggttgcctttcccctttctaaataccctcagattcctaacatcgagcccatgctttgtttgatttgttctattccatccattgtcccttttgttactgacagttgccttggtcctagccagtccctgccatgagatcataggggttcccattgtgctagatcttgggaaaccagatgactctccctgtcaaaactatggctacgtcactgtaaaccatttctgtcaagaataaaagtatgtagacccagagtgtgggcctaa

SEQ ID NO: 17716 - DNA, 2330 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaactttagaaa

SEQ ID NO: 17717 - DNA, 2352 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaagggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagagatggagtttcgctcttgttgcccaggctggagtgcaatggcactatctcgactcactgcaacctctgcctcccgggttcaaacgattctcctgcctcagcctcccacgtagctgggattatatagaagatgacatgaagattgatgagaaatgtgtggaagcagaaaaagaaagcattgagacagacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaacttt

SEQ ID NO: 17718 - DNA, 2457 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatcaatctccttgaagggagaagatgacatgaagattgatgagaaatgtgtggaagcagagaacagcactgcagagtctgaggagctcaattcagacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaacttt

SEQ ID NO: 17719 - DNA, 2244 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgagggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatcaatctccttgaagggagaagatgacatgaagattgatgagaaatgtgtggaagcagagaacagcactgcagagtctgaggagctcaattcagacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaacttt

SEQ ID NO: 17720 - DNA, 2462 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatcaatttctatggaagaagaagatgacatgaagattgatgagaaatgtgtggaagcagatgaagaaacatttgaatctgaggaactttcagaagacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaactttagaaa

SEQ ID NO: 17721 - DNA, 5552 bp, Homo sapiens
gttttagacttagaggcgcgcgactgcgcgcacccggctggagctgcggagaggaccaatgagcgggcgctctctccgctccggctcgggattgggcaagccgcgccagcctctcacgggcggggtgggactcggatccgcgcgcccactgcgccagagtcccgggggcgcgtgcgcggtctcgcggcggccgcaggggccggtctcgcgcggtctagaagtggagttgctggcggctgcggcggtgacggcggcgacggaggaggcaggcggtggggcgggggcggggactaaggattctgaggtggggagtcgggagtttctggattctttatccggaatttcaagggccgccggagggctgtcgcttctgcagtgcgtaggagcggccggggcgggaggctccgcggagccgaggcgtggagaataagaaagccttgagttttgtgaaaaaccggagaagagaaactaaaaggacagtagaaaaggcttttccagtttgcataatatttccttcatggatactttttcatagcattattatgtgatgtgagaagtttttttttttgaagtaacatggattttatactacagaatcaagagaattggcttataggaaaaattgatttataaaaagtggtacaggttttcatagataaccatgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactgtggccagaatgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaagcca

SEQ ID NO: 17722 - DNA, 5006 bp, Homo sapiens
gggagtttctggattctttatccggaatttcaagggccgccggagggctgtcgcttctgcagtgcgtaggagcggccggggcgggaggctccgcggagccgaggcgtggagaataagaaagccttgagttttgtgaaaaaccggagaagagaaactaaaaggacagtagaaaaggcttttccagtttgcataataggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactgtggccagaatgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaagcca

SEQ ID NO: 17723 - DNA, 479 bp, Homo sapiens
cttcccccacacgctgcgcaaactccggccagcgggagacccctggcagccaggcgggcttcctcaggcgcgcgagctgcggccgtggagggtgtgagcccaacctttgtccctcggagcaacgctgcctgcgcggtgcccgctccttctgcttggctgggcatgcaccttggcgcgggccacagccagccgagcccgaggtgcagggggcgcggcggggagtcgtctgccccctgcgccctctctccgaggtcgcgacgcgcgggactctcccggccgggtctgggaaatcggcgagggaacgctttcctttagaagtcagaatgtagtcagcgttcctctgcctgactcagctgctgaataagaaagccttgagttttgtgaaaaaccggagaagagaaactaaaaggacagtagaaaaggcttttccagtttgcataataggaacatcagaagcaccgagagatggctgttgactg

SEQ ID NO: 17724 - DNA, 567 bp, Homo sapiens
ctttatccggaatttcaagggccgccggagggctgtcgcttctgcagtgcgtaggagcggccggggcgggaggctccgcggagccgaggcgtggagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatct

SEQ ID NO: 17725 - DNA, 3799 bp, Homo sapiens
ggctggctgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagcattttgtatatgttttgatttagtacccttgcctttttcatcaaaggaattttcaaatcattcactctaacattggtctcatattttcactgtgataatgaatattacttgaaatagttttgtaaagctgtcatttagttcagtattcaaatagtgaagggttagtcttaatagaagaaaatatagttattgaccttccttcttataaatttcttacaaaagcagaattttaagtcagtgttatagctagtctactaccatctaaatctgacatcaaaagtctgatcagtttacgtattttcattatttcggagatgtatggctatccattctaatttatacagctatattagttttgtctcttcatttctatctttactgaaaaattgaagagcaataccttgcactctcttttgaggttattctttttatttgttgcagtgatatgatgctaactaatttaacatgtacacagtaagctctggggctggaagcaaggtcatgcagactgagagagtgccttatcctgtaaaaccttacagcaaaatgacacttgaagaaagtttattttcacatgtaaaattttgactgacaaaaggaacctactactttaaacaatggttttattagaacatggtcagcaaatgtatcatgcctctgcaaattttagtgatgtttagagatgcctctaagtttgcagttggaggtttttgtgcttttagaaatgtgatgtgatccttagggtacctgttttgtctgttgtgttgagaaccaaacccattgaacaacttaaaaaattgggaaataattgtcagctattttgtatacatacacacaaaatatatacattatataatatgtatattatgtattatataatatatataaaatgttttgtatattttttacatatctgttaaaaaatgtactttgtttttttgtttgtttgttttgagatggagtctctctctgtcacccatgctggagtacagtggcgcgatctcagcccgctgcaacctctgcctcctgggttcatgcgactctcgtgcctcagcctcccaagtaattgagattacagttgggtgccaccatgtccggctaatttttgtatttttagtacagatggggtttcaccatgttggccagggtggtctcgagctcctgacctcaagtgatccacccaccttggcctcccaaagtgctgagattacaagcatgagccactgcacctagccaagaagtgtactttttgtttaatgattaccgaaagaagttctcctttagaagcattgacttatacaaattcccacattcacctcagttaatatcttcctttaggattcttggataatagaaattcttcctaaaacatactcagagatgcagctcattattaaattaaggtaaccacattctgtattgttgctagcttttcatgtaaacattattcacactttaaaggattaggtgtttaaatattgatggtcatctttgtctggtgttaggtgccagacacctggctgctgaatttgttttttccctcaccaaagttgtcatttggaacgccagctgggaggactttgaaggaaaagaaaatatatgacaataggcagtattgacacattgtttaaaatctttttcacaataaaacaaaacacccaa

SEQ ID NO: 17726 - DNA, 3848 bp, Homo sapiens
caactacgagccacgagtttgcagatggggctgctcggcggcgcctgtggctgagggagagcagcggcggcggggagcgaccgggagcggcggcagcggcggcgcggaggcggctgaggtgcgagccggactaaatcattttgctactttaaaaaaatcacgaaagtacattatttgaagtttggagaagaaagggatttggtaacaaaggacagccatttccattttaagcagctaaacagcaggagagatttctgtaagaaggtaccagctcagattccattgttcatcattttgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagcattttgtatatgttttgatttagtacccttgcctttttcatcaaaggaattttcaaatcattcactctaacattggtctcatattttcactgtgataatgaatattacttgaaatagttttgtaaagctgtcatttagttcagtattcaaatagtgaagggttagtcttaatagaagaaaatatagttattgaccttccttcttataaatttcttacaaaagcagaattttaagtcagtgttatagctagtctactaccatctaaatctgacatcaaaagtctgatcagtttacgtattttcattatttcggagatgtatggctatccattctaatttatacagctatattagttttgtctcttcatttctatctttactgaaaaattgaagagcaataccttgcactctcttttgaggttattctttttatttgttgcagtgatatgatgctaactaatttaacatgtacacagtaagctctggggctggaagcaaggtcatgcagactgagagagtgccttatcctgtaaaaccttacagcaaaatgacacttgaagaaagtttattttcacatgtaaaattttgactgacaaaaggaacctactactttaaacaatggttttattagaacatggtcagcaaatgtatcatgcctctgcaaattttagtgatgtttagagatgcctctaagtttgcagttggaggtttttgtgcttttagaaatgtgatgtgatccttagggtacctgttttgtctgttgtgttgagaaccaaacccattgaacaacttaaaaaattgggaaataattgtcagctattttgtatacatacacacaaaatatatacattatataatatgtatattatgtattatataatatatataaaatgttttgtatattttttacatatctgttaaaaaatgtactttgtttttttgtttgtttgttttgagatggagtctctctctgtcacccatgctggagtacagtggcgcgatctcagcccgctgcaacctctgcctcctgggttcatgcgactctcgtgcctcagcctcccaagtaattgagattacagttgggtgccaccatgtccggctaatttttgtatttttagtacagatggggtttcaccatgttggccagggtggtctcgagctcctgacctcaagtgatccacccaccttggcctcccaaagtgctgagattacaagcatgagccactgcacctagccaagaagtgtactttttgtttaatgattaccgaaagaagttctcctttagaagcattgacttatacaaattcccacattcacctcagttaatatcttcctttaggattcttggataatagaaattcttcctaaaacatactcagagatgcagctcattattaaattaaggtaaccacattctgtattgttgctagcttttcatgtaaacattattcacactttaaaggattaggtgtttaaatattgatggtcatctttgtctggtgttaggtgccagacacctggctgctgaatttgttttttccctcaccaaagttgtcatttggaacgccagctgggaggactttgaaggaaaagaaaatatatgacaataggcagtattgacacattgtttaaaatctttttcacaataaaacaaaacacccaa

SEQ ID NO: 17727 - DNA, 1703 bp, Homo sapiens
gggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaac

SEQ ID NO: 17728 - DNA, 1191 bp, Homo sapiens
gggagtcgcggtggagcctgaatggagagccggcctgggggcggcgttgctgtgactgacacctccggggtctgtcccgagagggggtgattccgccggctcccggttctctcccgagctcggagttggtaggggaggaggctttctccaactaccgccgctacttccgaggtacgagactccagttgtttggccaaagtggctgtgggccgagcacaggctgccgcgggggcgttcgctgctgagatcgtgctcgcggattctcgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaa

SEQ ID NO: 17729 - DNA, 982 bp, Homo sapiens
cgcgcccaagcggcggcggcggcggcggctggaggaggaggaggaggaggaggaggaggaggagggcggctgaggcgcggctggctgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccgcagcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacag

SEQ ID NO: 17730 - DNA, 5080 bp, Homo sapiens
aggtatagcagtcttggcagttgctgaactgaattcctggctgatttccttactgcataaactcaactgctctcactgaggtcgtcattaagtcctgtgtgtgtttgggcaggccgacttgatttacagccagcactccactgcggaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaagagaaatttccataattgtctttttctatagagtgcatgatgaaatcaattacagttttggtagtagggtttttaaatctatatcactgtcatagatgtacaatcttggttcaagttgaatgctggttttgtttgtatctttttacagccttatttcaaacgccatgtgttagtataagatccgaaatcaaaatatgcacagtactgtattctaagcaaaacctcaaaccttctcgttgtcttcaataccgctctatctccaagatgaggctgaaattttcagagagacttagctagaggcttagtatgtatgggagttcagcgcttctgctggtctcaggtgtggctgctgctgtcgagtttgaatgttagctgttgaaggtatcaattcagcagccatgagcagctccagacagacaggtgagctctgctgtttctgggtggatcatcacagatttagccgggcaggcagtaaggtgtcctcttactattcaaaaagtgtagactttcttacatattcgcaatacgttcacagtgtgtgcattttaaaataattcttaaaggagtaactgaaattttaccttgagtgaatggccttcataatatagcttgagaagtccttttgagtacctgtcagtgactcaacaacatttaataagggaaagtagacttttaacagttattatatatgtaacgaaaagcctttcctttgggattaatataagtaagaatggtagccttgtggcaagaaatgattacaaaggatatttttatttgtaattcctcagaagacaatttatgaagtcacccaaaatgttattttagctggttttggatttttccaataaattagaagaaggatttctattctaaaacatgtaaaacctgttttacatattactgatacaattaaagattatttttcatctatgtgcaatagatcacccctctttaaattgctctaagatttattttagaaaacttttcatgtgatgttatttctttgtcatcaaaatgcttgttaacactgtccagacaccatcctaaccttgccattgttaaagaagtttaggaaagactcttatattgtaaatatttagatgggttctctcacttttctttgatactactgattttcagcaagtgaattatataattcaaaatgctagaaatgtctatccgttctataagagagcatatcctgccgttcttgcatgcagtgaagccctgcccgtcgaaaatcattgcatctgtgactttcaaagtggaaaaaaaaatgttatttttttgttgatttgtaaagagagtttaaatgtcatgtgaaaaaaaatagaatgtagtaaaattctatatatttatgaaatattttaaaggcatatttttttaaatatcaaacggggctattcataaaataaactgattgtatgtcaagatgtcctaatttaaaagagtagttttataaatcatggtcaacattccatgtaaatatttgagctttacaaagatagatccaagtgtgcgatctgtgcactgcacatttgatagcattattcactggttttccttcatacttgtcaagttcatattagaagcagagacaaaaaccactccaatggccttgacacatagtcacaccaaaatagataatcagactaagtattatataacaacgtgatccagacagtgagttctaagtgtattaattaaatagcaaaaaattttgtttttaaaaaatgaaagagggagggttgccaacctgaagtcttaagtagattgtttgggtagcatatttccttctttgaacattgtctgaaattttctataaatcaagacttcttgtacaaagaatgatgggacatatgtaataattcaggcaatcacctgagtaatttaggcagtccaaattctttaccctgaaatacccacattttaaaaaaattgcagataattgcttcagttatttactttggggacagagatatagtgtaaagtgggagaaactgagtccttttttggtggtggtaataataagatgttataaaaatataacattttaaaaaagaaaggtccagaccttaagcgcagagctagaacaatattttttaaataatggggggaaaagggggcactttggtaattttagaaatcaggtagtatacttttttttttttttttgagacagggtcttgccatgttgctcaggctggtcttgaactcctgggctcaagcaatcctcctgccttggcctcccaaagtgctgggattacaggcatgatccaccgtgcccagccggtagacgtggtcttaaaaacagtgtttacatggccatcttgatgcttagaaagataattgattaaaatttaataaggcagggccaactccgagagttcattgacaacggcagcaaaaaggccctgaattctgtactttcttcccccagcctccttctccagcaaggagaatagcactcctccctccagaagccagctccctaagttggagccactatgtaagagaagaggaacgttcactttttaaaattcatatatttaaaaatcaagaccaaaaagtaaattctgtactcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgtacttacttgaaaattgtttttgcacttggatattctattttattatactactattgtgatctattccattatactatttcccatggtagaacaaattatattttctactgtgatatgaagtgatgtaattgaacttgccatgtctaaaattaaatttcatatttttttcaatcaaa

SEQ ID NO: 17731 - DNA, 2090 bp, Homo sapiens
ataaacagcaggttctcctaggctttgaacaaaatttagcttctccaaggccaaaagcctcattgtgaagagaaagaaaggtatagcagtcttggcagttgctgaactgaattcctggctgatttccttactgcataaactcaactgctctcactgaggtcgtcattaagtcctgtgtgtgtttgggcaggccgacttgatttacagccagcactccactgcggaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaa

SEQ ID NO: 17732 - DNA, 5063 bp, Homo sapiens
aatggaactaacaggaaccacctgtgcacttccttttacaggaatgttcataaacagcaggttctcctaggctttgaacaaaatttagcttctccaaggccaaaagcctcattgtgaagagaaagaaagaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaagagaaatttccataattgtctttttctatagagtgcatgatgaaatcaattacagttttggtagtagggtttttaaatctatatcactgtcatagatgtacaatcttggttcaagttgaatgctggttttgtttgtatctttttacagccttatttcaaacgccatgtgttagtataagatccgaaatcaaaatatgcacagtactgtattctaagcaaaacctcaaaccttctcgttgtcttcaataccgctctatctccaagatgaggctgaaattttcagagagacttagctagaggcttagtatgtatgggagttcagcgcttctgctggtctcaggtgtggctgctgctgtcgagtttgaatgttagctgttgaaggtatcaattcagcagccatgagcagctccagacagacaggtgagctctgctgtttctgggtggatcatcacagatttagccgggcaggcagtaaggtgtcctcttactattcaaaaagtgtagactttcttacatattcgcaatacgttcacagtgtgtgcattttaaaataattcttaaaggagtaactgaaattttaccttgagtgaatggccttcataatatagcttgagaagtccttttgagtacctgtcagtgactcaacaacatttaataagggaaagtagacttttaacagttattatatatgtaacgaaaagcctttcctttgggattaatataagtaagaatggtagccttgtggcaagaaatgattacaaaggatatttttatttgtaattcctcagaagacaatttatgaagtcacccaaaatgttattttagctggttttggatttttccaataaattagaagaaggatttctattctaaaacatgtaaaacctgttttacatattactgatacaattaaagattatttttcatctatgtgcaatagatcacccctctttaaattgctctaagatttattttagaaaacttttcatgtgatgttatttctttgtcatcaaaatgcttgttaacactgtccagacaccatcctaaccttgccattgttaaagaagtttaggaaagactcttatattgtaaatatttagatgggttctctcacttttctttgatactactgattttcagcaagtgaattatataattcaaaatgctagaaatgtctatccgttctataagagagcatatcctgccgttcttgcatgcagtgaagccctgcccgtcgaaaatcattgcatctgtgactttcaaagtggaaaaaaaaatgttatttttttgttgatttgtaaagagagtttaaatgtcatgtgaaaaaaaatagaatgtagtaaaattctatatatttatgaaatattttaaaggcatatttttttaaatatcaaacggggctattcataaaataaactgattgtatgtcaagatgtcctaatttaaaagagtagttttataaatcatggtcaacattccatgtaaatatttgagctttacaaagatagatccaagtgtgcgatctgtgcactgcacatttgatagcattattcactggttttccttcatacttgtcaagttcatattagaagcagagacaaaaaccactccaatggccttgacacatagtcacaccaaaatagataatcagactaagtattatataacaacgtgatccagacagtgagttctaagtgtattaattaaatagcaaaaaattttgtttttaaaaaatgaaagagggagggttgccaacctgaagtcttaagtagattgtttgggtagcatatttccttctttgaacattgtctgaaattttctataaatcaagacttcttgtacaaagaatgatgggacatatgtaataattcaggcaatcacctgagtaatttaggcagtccaaattctttaccctgaaatacccacattttaaaaaaattgcagataattgcttcagttatttactttggggacagagatatagtgtaaagtgggagaaactgagtccttttttggtggtggtaataataagatgttataaaaatataacattttaaaaaagaaaggtccagaccttaagcgcagagctagaacaatattttttaaataatggggggaaaagggggcactttggtaattttagaaatcaggtagtatacttttttttttttttttgagacagggtcttgccatgttgctcaggctggtcttgaactcctgggctcaagcaatcctcctgccttggcctcccaaagtgctgggattacaggcatgatccaccgtgcccagccggtagacgtggtcttaaaaacagtgtttacatggccatcttgatgcttagaaagataattgattaaaatttaataaggcagggccaactccgagagttcattgacaacggcagcaaaaaggccctgaattctgtactttcttcccccagcctccttctccagcaaggagaatagcactcctccctccagaagccagctccctaagttggagccactatgtaagagaagaggaacgttcactttttaaaattcatatatttaaaaatcaagaccaaaaagtaaattctgtactcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgtacttacttgaaaattgtttttgcacttggatattctattttattatactactattgtgatctattccattatactatttcccatggtagaacaaattatattttctactgtgatatgaagtgatgtaattgaacttgccatgtctaaaattaaatttcatatttttttcaatcaaa

SEQ ID NO: 17733 - DNA, 1067 bp, Homo sapiens
aaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggca

SEQ ID NO: 17734 - DNA, 1856 bp, Homo sapiens
gtgttggttactagccgggctggaggcgggggccgggctcccactgggctcgtgcgttctgcgcccgccgcggcggtgccgagcccgctggctcccgattgtcctctgcggcggtggcggtcgctgcctccttgcctccgggcccggggctgcaggggccagagcgagtgcgcctcctgcccgcggaccgcggcagcccagagcagaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactgattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatggaccatggtttctccttccactgatggctgtaccctggggtgcaaaacctccaaatgctagaatgacctgcggaagccctttggacctctaaaggaagatgaatctggagtaaaagtgtttcaagaatcaggaaggctgcctcctgacttgggcactgtgttagtcccttgttgcactgctctgaagaaatacctgaaactggacagtgaagcatttaaggacactagaa

SEQ ID NO: 17735 - DNA, 4760 bp, Homo sapiens
agaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaagagaaatttccataattgtctttttctatagagtgcatgatgaaatcaattacagttttggtagtagggtttttaaatctatatcactgtcatagatgtacaatcttggttcaagttgaatgctggttttgtttgtatctttttacagccttatttcaaacgccatgtgttagtataagatccgaaatcaaaatatgcacagtactgtattctaagcaaaacctcaaaccttctcgttgtcttcaataccgctctatctccaagatgaggctgaaattttcagagagacttagctagaggcttagtatgtatgggagttcagcgcttctgctggtctcaggtgtggctgctgctgtcgagtttgaatgttagctgttgaaggtatcaattcagcagccatgagcagctccagacagacaggtgagctctgctgtttctgggtggatcatcacagatttagccgggcaggcagtaaggtgtcctcttactattcaaaaagtgtagactttcttacatattcgcaatacgttcacagtgtgtgcattttaaaataattcttaaaggagtaactgaaattttaccttgagtgaatggccttcataatatagcttgagaagtccttttgagtacctgtcagtgactcaacaacatttaataagggaaagtagacttttaacagttattatatatgtaacgaaaagcctttcctttgggattaatataagtaagaatggtagccttgtggcaagaaatgattacaaaggatatttttatttgtaattcctcagaagacaatttatgaagtcacccaaaatgttattttagctggttttggatttttccaataaattagaagaaggatttctattctaaaacatgtaaaacctgttttacatattactgatacaattaaagattatttttcatctatgtgcaatagatcacccctctttaaattgctctaagatttattttagaaaacttttcatgtgatgttatttctttgtcatcaaaatgcttgttaacactgtccagacaccatcctaaccttgccattgttaaagaagtttaggaaagactcttatattgtaaatatttagatgggttctctcacttttctttgatactactgattttcagcaagtgaattatataattcaaaatgctagaaatgtctatccgttctataagagagcatatcctgccgttcttgcatgcagtgaagccctgcccgtcgaaaatcattgcatctgtgactttcaaagtggaaaaaaaaatgttatttttttgttgatttgtaaagagagtttaaatgtcatgtgaaaaaaaatagaatgtagtaaaattctatatatttatgaaatattttaaaggcatatttttttaaatatcaaacggggctattcataaaataaactgattgtatgtcaagatgtcctaatttaaaagagtagttttataaatcatggtcaacattccatgtaaatatttgagctttacaaagatagatccaagtgtgcgatctgtgcactgcacatttgatagcattattcactggttttccttcatacttgtcaagttcatattagaagcagagacaaaaaccactccaatggccttgacacatagtcacaccaaaatagataatcagactaagtattatataacaacgtgatccagacagtgagttctaagtgtattaattaaatagcaaaaaattttgtttttaaaaaatgaaagagggagggttgccaacctgaagtcttaagtagattgtttgggtagcatatttccttctttgaacattgtctgaaattttctataaatcaagacttcttgtacaaagaatgatgggacatatgtaataattcaggcaatcacctgagtaatttaggcagtccaaattctttaccctgaaatacccacattttaaaaaaattgcagataattgcttcagttatttactttggggacagagatatagtgtaaagtgggagaaactgagtccttttttggtggtggtaataataagatgttataaaaatataacattttaaaaaagaaaggtccagaccttaagcgcagagctagaacaatattttttaaataatggggggaaaagggggcactttggtaattttagaaatcaggtagtatacttttttttttttttttgagacagggtcttgccatgttgctcaggctggtcttgaactcctgggctcaagcaatcctcctgccttggcctcccaaagtgctgggattacaggcatgatccaccgtgcccagccggtagacgtggtcttaaaaacagtgtttacatggccatcttgatgcttagaaagataattgattaaaatttaataaggcagggccaactccgagagttcattgacaacggcagcaaaaaggccctgaattctgtactttcttcccccagcctccttctccagcaaggagaatagcactcctccctccagaagccagctccctaagttggagccactatgtaagagaagaggaacgttcactttttaaaattcatatatttaaaaatcaagaccaaaaagtaaattctgtactcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgt

SEQ ID NO: 17736 - DNA, 5367 bp, Homo sapiens
tattttcagaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaagtcgatcaagtaacatttcaaaagcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattacgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatgcaaatatttaacttcccagtagccctattttaaaaagtaaaaataaatgtttgtttgttaaaatgaattttgattttttaaaaacactatatgttatttcaacatgtcatcaatataaaaaattgattgattgattgatagtttacatctgtttcttgaaccaagttttcaaaatccagttggtaatttaaaagtacacttcaacttgaattaactatattggatagcacagccgtaaaattagagactaagcttctgctttatttaacagttgttgagtatttcaaaacagtttaattcattcttttatttcaaagtcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatccatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaagggaaaaaaaaaacaaacctttaaatgaggagaaagatggtataaatattagtagtggctgacactgagtccagatagtcttgattcctagaaataaacaaaaggtaaacaatgtcaattttgtgtgtgtgtatggcgtgtgtgtagtcatgtatatatgcggggaaaatgttaaggtattcagtcaggaaacaaaaggtttaaaactcatctttcttaaaacttgttataagcacagggaaagcaaagttgaggtaactaaactgaaccaaaaattctgtataaataaggatataagtaattaacgttttaaaaaacatgtggaccttaaacaaactgtatattaaattcctcttaaatgcccattttaaatatttaagataaatacatttatgaataacaaatctgtgggtgatttaaccatggcaccatatccaagggattaaccttaatgcaattttcctgttaattgtcctaagctttttactaatccattttccctgtgggttagtaatggcaacatgctgcttacagatattcccggggaaaaacatccagacaccagcaaacaaagaaatgttgatttctcttttgtttgctctgaaagtaaaataattatttactttaattaacatggaaaatattgtttaaattctgtacgaacctaaacaagatacgttgcagggctgatttcacagtggaggatgatcggctaaaataaagcctcatttattaagggctacacttttaacactaagaaaacatttctagaataaaaagcaaaggtaagcattattctattaatagtaaaagaggacatgggattttaaaactatacctaaattcttgcaattaacttttatgggcttggacattgttgaaatgagaaaataatataatatagcttcctggcaggttaaaagtcaacacttgattttgctattcttctgactttttgaaaccctgaagttctgaatttcaagcttttaagaagcttttcagcaatggttgtttgtttatggttcaaacatctgaaataactacctgcatttaaaatctaatgttgattattttctttttacattctgtgtggcaatggaacatttgccctttcaaacaataaaacgatttagctttgtggcagtgcttttttgtagactgactgactatacccttcaaaaagaaaaactgctctacggaatgcaaattttgaggcatgtttacctgctcgtggaagaaataaaatggaattgaaaaaaaaaggactaaaattgaagaatgaaattacagttgtgttaaaaaccttggctctttataatcatgaatcttcagtattaaaccagacattgatgctgttaatttttttaaagaactatcactcttatcgtacaggagtaaagattaaattgtaaaagaaagaaattccaattttttaaaaagtaaagcccaaaaggcaattaagcttaagtacaaaaacaaaataaaaatgaacaaaatctaaactaaagtgagcccaacaacctgagatacagcaatgtgtaacctgaaggaagataggtgtagactgaaggagtctttcaaaacaccccagcattaaatctcactctgcgctgcttctacacgtgattatagtcccagacagacgacctcatggttttttatcttgttttacaaaaggtccttgggtactctttaaaacatctattctttggcaggaaaattagctcattagaacaatgacaccattaagggacattataagggtcctggggctgaggtgggaagatttttctatctgccccatatagtttacccttccttgccttgaaaatgaatattatagaacagagtacagctcttaaaagttattagtatcattattattatagttgttatataatactttaattaagaaagatgaaaaccttttttctttcctaagtcagcccaatggtgctattttacatatcaacacagttgaaaggaagtactgttattttgggctgcagtgtttcctccacatctaaagaaagcccattttgaaactggatactgcattaaaacaaagaaggaaaaattattttaactgtgtgcagtttttgaaattaggcatttgtactattttggttttacataattctcttgcattaacaatttactgttttgtgaatcatgtgtactaaagcaaattaagaaaaagaaaataattatctgtgaaagactttgtatattaaacaagtgacgcaaaccttagttgtggtttccacaatttttgcctaacagactgatatttgtatttgcaacatccaaacacacatacattttttaagattttacaagggtctgaacatataattattttaaagcaaacctacgttgactaactcatgacatggtacaaataaataaatacacaaacagagggaaaccaatgaaaataaactatgtggactttcaaacctgctttaaaaaaagagttcaagagaaatcacaatgtaatctaaagcgggactgtctcaagaataagtcttggatatagaaaaataagcatataacagcatttttctgttcagagataatagtggattcagataattgcatggataataaacattaaaagcaagatattagaatctaagaggtttggtgatagcaaaaaacaaagctgtttcc

SEQ ID NO: 17737 - DNA, 2476 bp, Homo sapiens
ctatattctctgttctgcattataagcaacatgaccagcagccacgtttgttgtaattttttaaatatgtggaaaaaaagcaagatatcaaccatgtattaccttaaccaagatgccaaattatctaacttgtttctccaggcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattacgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatgcaaatatttaacttcccagtagccctattttaaaaagtaaaaataaatgtttgtttgttaaaatgaattttgattttttaaaaacactatatgttatttcaacatgtcatcaatataaaaaattgattgattgattgatagtttacatctgtttcttgaaccaagttttcaaaatccagttggtaatttaaaagtacacttcaacttgaattaactatattggatagcacagccgtaaaattagagactaagcttctgctttatttaacagttgttgagtatttcaaaacagtttaattcattcttttatttcaaagtcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatccatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgactta

SEQ ID NO: 17738 - DNA, 5877 bp, Homo sapiens
agaggaggggagaggactggggagccgagccagagccgggctgcctgccacccggctgctcgtccgctagctggggaggagcgctccacccgcaactgacaaaggatgggagaatgcccgcgccccgggatgccggccgcacgcagcctggcggccgcctgagctacttcaccctccgccggtaagtgactgcaaacatcattcattcaatcagcctcactgggagccccttctctccggctggtagtcctgggcggcttgtccctgatcccgagcggggcttggcacagcatcagccctggagggcaggcagcaggtgcctttgcctggtgggtccactggggagcgtggctggggttcgcggcgggtgctgccacccaacctgcgggcggcgggctcgcccagtaggcgcctctctggtgagaggaggcggctccagcccgcagcctggggtagttgctactattggcccccagcgcccgctctgcgcgcgcgccgtttctggcggatccccagtgcgcggcgcgctgtttacaccggcgtggtactagtcacggagccgcacccctcggaaagcgcggagtcgatgacagccacttcacaggctcacgcgctcctagtgtgggcttgaaggggacggggaccgattaccaaaggagagcgctgagtacggaagacacagggcagcctttgtcttgggtttagcgctgatgcgctcaaccctgagtcgggttcactgcaactgttgtgtccgatttcggttccctgcaaccgccctcctgggcgagagatgtcattgtgttcctgcggccagcgggactgagagctgggacttaagacgccaggagggtcctgcgctcacgggaaatgtaccccaaaagaactctgagagaatatactcaactgtcctgctgtgattaaacaagactgctgtattttaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaagtcgatcaagtaacatttcaaaagcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattacgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatgcaaatatttaacttcccagtagccctattttaaaaagtaaaaataaatgtttgtttgttaaaatgaattttgattttttaaaaacactatatgttatttcaacatgtcatcaatataaaaaattgattgattgattgatagtttacatctgtttcttgaaccaagttttcaaaatccagttggtaatttaaaagtacacttcaacttgaattaactatattggatagcacagccgtaaaattagagactaagcttctgctttatttaacagttgttgagtatttcaaaacagtttaattcattcttttatttcaaagtcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatccatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaagggaaaaaaaaaacaaacctttaaatgaggagaaagatggtataaatattagtagtggctgacactgagtccagatagtcttgattcctagaaataaacaaaaggtaaacaatgtcaattttgtgtgtgtgtatggcgtgtgtgtagtcatgtatatatgcggggaaaatgttaaggtattcagtcaggaaacaaaaggtttaaaactcatctttcttaaaacttgttataagcacagggaaagcaaagttgaggtaactaaactgaaccaaaaattctgtataaataaggatataagtaattaacgttttaaaaaacatgtggaccttaaacaaactgtatattaaattcctcttaaatgcccattttaaatatttaagataaatacatttatgaataacaaatctgtgggtgatttaaccatggcaccatatccaagggattaaccttaatgcaattttcctgttaattgtcctaagctttttactaatccattttccctgtgggttagtaatggcaacatgctgcttacagatattcccggggaaaaacatccagacaccagcaaacaaagaaatgttgatttctcttttgtttgctctgaaagtaaaataattatttactttaattaacatggaaaatattgtttaaattctgtacgaacctaaacaagatacgttgcagggctgatttcacagtggaggatgatcggctaaaataaagcctcatttattaagggctacacttttaacactaagaaaacatttctagaataaaaagcaaaggtaagcattattctattaatagtaaaagaggacatgggattttaaaactatacctaaattcttgcaattaacttttatgggcttggacattgttgaaatgagaaaataatataatatagcttcctggcaggttaaaagtcaacacttgattttgctattcttctgactttttgaaaccctgaagttctgaatttcaagcttttaagaagcttttcagcaatggttgtttgtttatggttcaaacatctgaaataactacctgcatttaaaatctaatgttgattattttctttttacattctgtgtggcaatggaacatttgccctttcaaacaataaaacgatttagctttgtggcagtgcttttttgtagactgactgactatacccttcaaaaagaaaaactgctctacggaatgcaaattttgaggcatgtttacctgctcgtggaagaaataaaatggaattgaaaaaaaaaggactaaaattgaagaatgaaattacagttgtgttaaaaaccttggctctttataatcatgaatcttcagtattaaaccagacattgatgctgttaatttttttaaagaactatcactcttatcgtacaggagtaaagattaaattgtaaaagaaagaaattccaattttttaaaaagtaaagcccaaaaggcaattaagcttaagtacaaaaacaaaataaaaatgaacaaaatctaaactaaagtgagcccaacaacctgagatacagcaatgtgtaacctgaaggaagataggtgtagactgaaggagtctttcaaaacaccccagcattaaatctcactctgcgctgcttctacacgtgattatagtcccagacagacgacctcatggttttttatcttgttttacaaaaggtccttgggtactctttaaaacatctattctttggcaggaaaattagctcattagaacaatgacaccattaagggacattataagggtcctggggctgaggtgggaagatttttctatctgccccatatagtttacccttccttgccttgaaaatgaatattatagaacagagtacagctcttaaaagttattagtatcattattattatagttgttatataatactttaattaagaaagatgaaaaccttttttctttcctaagtcagcccaatggtgctattttacatatcaacacagttgaaaggaagtactgttattttgggctgcagtgtttcctccacatctaaagaaagcccattttgaaactggatactgcattaaaacaaagaaggaaaaattattttaactgtgtgcagtttttgaaattaggcatttgtactattttggttttacataattctcttgcattaacaatttactgttttgtgaatcatgtgtactaaagcaaattaagaaaaagaaaataattatctgtgaaagactttgtatattaaacaagtgacgcaaacctta

SEQ ID NO: 17739 - DNA, 656 bp, Homo sapiens
gtccgctagctggggaggagcgctccacccgcaactgacaaaggatgggagaatgcccgcgccccgggatgccggccgcacgcagcctggcggccgcctgagctacttcaccctccgccggaaatgtaccccaaaagaactctgagagaatatactcaactgtcctgctgtgattaaacaagactgctgtattttaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaagtcgatcaagtaacatttcaaaagcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaag

SEQ ID NO: 17740 - DNA, 3100 bp, Homo sapiens
ggttgctagggaaaccggaggacgcccggtagccgcccccaccgcctccgccccaggcaaggccggccggcgccgcggaaagcagcctcggggaaggaggaggaagaggggcaggtgtagggagtgaagaagcaaaaagaggaggaggaagaggagctcagggccgtccccgcgcaattaatgggcggctcctgcgccctggaccggcccgcccgcccagcccctcgacccctgtagccccggcaggggaggaagggcagacccacaggtcagggattaggaatcatgttgcatgacgcaagggacaggcagaagttcttcagcgatgttcagtatctgcgggacatgcagcataaggtggactctgagtatcaggcttgtctgagacgacaggaatatagaagagacccaaatgagaagaaacgcgatcagttttgggggcaagagacaagttttgagagatcccggttttctagcaggtcatcttccaaacagagttctagtgaggaggatgctctaactgaaccaaggtcatctatcaagatatctgcatttaagtgtgactccaaacttccagcaattgaccaaacatcagtcaagcagaaacataaaagtaccatgactgtaaggaaagcagagaaagtggaccccagcgaaccctctccagcagaccaagcaccaatggttttattaagaaagaggaagccaaacctgaggagatttacagtcagcccagaatcgcacagcccgagagcatctggggacagaagcagacagaaacagcagtggcctgcaaaggtgccggttcccaggggagcagatcaagtagttcaacaagaaggcctgatgtgtaacactaagctgaagaggccaaatcaagagagaagaaacttggtcccatcgtcacagccaatgactgagaacgcccctgatagagccaaaaaaggagacccgagtgctccttcccagagtgagctgcatccagccctgtcccaggccttccaaggaaaaaatagtcctcaagtattgagtgagttctcggggccaccactcacacccaccactgtaggagggccaagaaaggcatcatttaggttccgagatgaagacttttattccattttgtcattgaacagcagaagagaaagcgatgacactgaagaggaaacccagtctgaagaatgtctgtgggttggtgtgcgctcaccctgttctccttcccatcacaaaagaagtagatttggggggacatcgacccctcaggccaaaaataaaaattttgaagaaaatgctgaaaattgcagaggtcattcttcaagaagaagtgagcccagtcatggctcattgagaataagcaatgcaatggagccagcaacagagcggccttctgctgggcaaaggttgtcccaagaccccgggctgcctgatagggaatctgctacagagaaggacagaggtggcagtgaaaatgcgaaaaagagccctctttcgtgggacaccaaatccgagcccagacaagaggttggtgtcaatgctgaaaatgtatggagtgattgtatttctgtggaacataggcctggcacccatgattctgaaggatactggaaagactatttaaacagttctcaaaattctcttgactactttatttctggcagaccaatatctccaagatcatcagtgaattcatcctataaccctcctgcatcattcatgcattctgctctgagagatgatattccagtagacttgtcaatgtcatcgacttcagttcacagctcagactcagagggaaactcagggtttcatgtttgccaaccactgtctcccattagaaataggactccatttgccagtgccgaaaaccataattatttcccagtaaacagtgcacacgaatttgctgtcagggaagcagaagatactactttaacaagccagcctcagggggctccactatatacagatctcttactaaatccacagggcaatttgtccttagtggattcttccagctcctctccatcaagaatgaactcagaaggccatttgcatgtgtctgggtctctgcaagaaaatacaccatttactttctttgcagtgtctcatttcccaaatcaaaatgataatgggagcaggatggcagcctctggtttcacagatgaaaaggaaaccagtaagataaaggcagaccctgagaaactcaagaaattgcaagaaagtctcctggaggaggactccgaggaggagggagacttgtgtcgcatctgtcagatagccgggggttccccaagcaaccccctcctggagccttgcggctgtgtgggaagcctgcagtttgttcatcaagagtgcctgaaaaagtggctgaaagtgaaaataacatcaggagcagatcttggtgccgtgaagacctgtgagatgtgtaagcaaggcctgctggttgacctgggtgactttaacatgattgagttctaccagaagcaccagcaatctcaggcacaaaacgagctgatgaattcaggcttgtacctggtgctgctgcttcacctctatgagcagaggtttgcagaactcatgaggctcaaccacaaccaggtggaaagagagaggttgtcaagaaattacccacaacccagaacagaggaaaatgaaaattcggagttgggagatggaaatgaaggcagcatttctcaaagccaggtcgtctagcaaggaagccaactgtggagctcggcggagacctctcctgccagcccttctttctacgtccccaagtgcctccctccctcctcctctttactgaaactgaaaccaaagcgttcacagttagattttcacctcgtgccactctcttttggggtctggcttgagcatctatgggcagccacagcgaccagtctagtcccagacagcacaggtcaagcagcgtgggactgtggagcccctggcaggctggcctggtgctgcccccttagcccagaagccctgccaggtccagtggcctggggtcccactgctgagggcacctgccaggcctcactccaccctgaatggactcgagccatgtattcattcagtaaactgacattattctccc

SEQ ID NO: 17741 - DNA, 3053 bp, Homo sapiens
gccaagaagaattactcgctcttgctttcagcaaggcaggaccccctccttccttctccacctgcctccaactccctcctcctttctctctccctacttaatatggcttcttatgttgatttctaaagcacagatttggcacaagacattatcaccagaaagacttaaaacagaagtgtgcataaccatgagtgggttttaaattaagaagcagttcaaaggtcagggattaggaatcatgttgcatgacgcaagggacaggcagaagttcttcagcgatgttcagtatctgcgggacatgcagcataaggtggactctgagtatcaggcttgtctgagacgacaggaatatagaagagacccaaatgagaagaaacgcgatcagttttgggggcaagagacaagttttgagagatcccggttttctagcaggtcatcttccaaacagagttctagtgaggaggatgctctaactgaaccaaggtcatctatcaagatatctgcatttaagtgtgactccaaacttccagcaattgaccaaacatcagtcaagcagaaacataaaagtaccatgactgtaaggaaagcagagaaagtggaccccagcgaaccctctccagcagaccaagcaccaatggttttattaagaaagaggaagccaaacctgaggagatttacagtcagcccagaatcgcacagcccgagagcatctggggacagaagcagacagaaacagcagtggcctgcaaaggtgccggttcccaggggagcagatcaagtagttcaacaagaaggcctgatgtgtaacactaagctgaagaggccaaatcaagagagaagaaacttggtcccatcgtcacagccaatgactgagaacgcccctgatagagccaaaaaaggagacccgagtgctccttcccagagtgagctgcatccagccctgtcccaggccttccaaggaaaaaatagtcctcaagtattgagtgagttctcggggccaccactcacacccaccactgtaggagggccaagaaaggcatcatttaggttccgagatgaagacttttattccattttgtcattgaacagcagaagagaaagcgatgacactgaagaggaaacccagtctgaagaatgtctgtgggttggtgtgcgctcaccctgttctccttcccatcacaaaagaagtagatttggggggacatcgacccctcaggccaaaaataaaaattttgaagaaaatgctgaaaattgcagaggtcattcttcaagaagaagtgagcccagtcatggctcattgagaataagcaatgcaatggagccagcaacagagcggccttctgctgggcaaaggttgtcccaagaccccgggctgcctgatagggaatctgctacagagaaggacagaggtggcagtgaaaatgcgaaaaagagccctctttcgtgggacaccaaatccgagcccagacaagaggttggtgtcaatgctgaaaatgtatggagtgattgtatttctgtggaacataggcctggcacccatgattctgaaggatactggaaagactatttaaacagttctcaaaattctcttgactactttatttctggcagaccaatatctccaagatcatcagtgaattcatcctataaccctcctgcatcattcatgcattctgctctgagagatgatattccagtagacttgtcaatgtcatcgacttcagttcacagctcagactcagagggaaactcagggtttcatgtttgccaaccactgtctcccattagaaataggactccatttgccagtgccgaaaaccataattatttcccagtaaacagtgcacacgaatttgctgtcagggaagcagaagatactactttaacaagccagcctcagggggctccactatatacagatctcttactaaatccacagggcaatttgtccttagtggattcttccagctcctctccatcaagaatgaactcagaaggccatttgcatgtgtctgggtctctgcaagaaaatacaccatttactttctttgcagtgtctcatttcccaaatcaaaatgataatgggagcaggatggcagcctctggtttcacagatgaaaaggaaaccagtaagataaaggcagaccctgagaaactcaagaaattgcaagaaagtctcctggaggaggactccgaggaggagggagacttgtgtcgcatctgtcagatagccgggggttccccaagcaaccccctcctggagccttgcggctgtgtgggaagcctgcagtttgttcatcaagagtgcctgaaaaagtggctgaaagtgaaaataacatcaggagcagatcttggtgccgtgaagacctgtgagatgtgtaagcaaggcctgctggttgacctgggtgactttaacatgattgagttctaccagaagcaccagcaatctcaggcacaaaacgagctgatgaattcaggcttgtacctggtgctgctgcttcacctctatgagcagaggtttgcagaactcatgaggctcaaccacaaccaggtggaaagagagaggttgtcaagaaattacccacaacccagaacagaggaaaatgaaaattcggagttgggagatggaaatgaaggcagcatttctcaaagccaggtcgtctagcaaggaagccaactgtggagctcggcggagacctctcctgccagcccttctttctacgtccccaagtgcctccctccctcctcctctttactgaaactgaaaccaaagcgttcacagttagattttcacctcgtgccactctcttttggggtctggcttgagcatctatgggcagccacagcgaccagtctagtcccagacagcacaggtcaagcagcgtgggactgtggagcccctggcaggctggcctggtgctgcccccttagcccagaagccctgccaggtccagtggcctggggtcccactgctgagggcacctgccaggcctcactccaccctgaatggactcgagccatgtattcattcagtaaactgacattattctccc

SEQ ID NO: 17742 - DNA, 3324 bp, Homo sapiens
aggcaaggccggccggcgccgcggaaagcagcctcggggaaggaggaggaagaggggcaggtgtagggagtgaagaagcaaaaagaggaggaggaagaggagctcagggccgtccccgcgcaattaatgggcggctcctgcgccctggaccggcccgcccgcccagcccctcgacccctgtagccccggcaggggaggaagggcagacccacagggccagatgataaaccatgtgagatttcataactaccagaccagacgctgggtcaccatgagtccggggcggcctgactctgccaatatctgcacaactgaataaacaggaggagcgagggaatgccgcagaacgtatacacctgaaggtcagggattaggaatcatgttgcatgacgcaagggacaggcagaagttcttcagcgatgttcagtatctgcgggacatgcagcataaggtggactctgagtatcaggcttgtctgagacgacaggaatatagaagagacccaaatgagaagaaacgcgatcagttttgggggcaagagacaagttttgagagatcccggttttctagcaggtcatcttccaaacagagttctagtgaggaggatgctctaactgaaccaaggtcatctatcaagatatctgcatttaagtgtgactccaaacttccagcaattgaccaaacatcagtcaagcagaaacataaaagtaccatgactgtaaggaaagcagagaaagtggaccccagcgaaccctctccagaccaagcaccaatggttttattaagaaagaggaagccaaacctgaggagatttacagtcagcccagaatcgcacagcccgagagcatctggggacagaagcagacagaaacagcagtggcctgcaaaggtgccggttcccaggggagcagatcaagtagttcaacaagaaggcctgatgtgtaacactaagctgaagaggccaaatcaagagagaagaaacttggtcccatcgtcacagccaatgactgagaacgcccctgatagagccaaaaaaggagacccgagtgctccttcccagagtgagctgcatccagccctgtcccaggccttccaaggaaaaaatagtcctcaagtattgagtgagttctcggggccaccactcacacccaccactgtaggagggccaagaaaggcatcatttaggttccgagatgaagacttttattccattttgtcattgaacagcagaagagaaagcgatgacactgaagaggaaacccagtctgaagaatgtctgtgggttggtgtgcgctcaccctgttctccttcccatcacaaaagaagtagatttggggggacatcgacccctcaggccaaaaataaaaattttgaagaaaatgctgaaaattgcagaggtcattcttcaagaagaagtgagcccagtcatggctcattgagaataagcaatgcaatggagccagcaacagagcggccttctgctgggcaaaggttgtcccaagaccccgggctgcctgatagggaatctgctacagagaaggacagaggtggcagtgaaaatgcgaaaaagagccctctttcgtgggacaccaaatccgagcccagacaagaggttggtgtcaatgctgaaaatgtatggagtgattgtatttctgtggaacataggcctggcacccatgattctgaaggatactggaaagactatttaaacagttctcaaaattctcttgactactttatttctggcagaccaatatctccaagatcatcagtgaattcatcctataaccctcctgcatcattcatgcattctgctctgagagatgatattccagtagacttgtcaatgtcatcgacttcagttcacagctcagactcagagggaaactcagggtttcatgtttgccaaccactgtctcccattagaaataggactccatttgccagtgccgaaaaccataattatttcccagtaaacagtgcacacgaatttgctgtcagggaagcagaagatactactttaacaagccagcctcagggggctccactatatacagatctcttactaaatccacagggcaatttgtccttagtggattcttccagctcctctccatcaagaatgaactcagaaggccatttgcatgtgtctgggtctctgcaagaaaatacaccatttactttctttgcagtgtctcatttcccaaatcaaaatgataatgggagcaggatggcagcctctggtttcacagatgaaaaggaaaccagtaagataaaggcagaccctgagaaactcaagaaattgcaagaaagtctcctggaggaggactccgaggaggagggagacttgtgtcgcatctgtcagatagccgggggttccccaagcaaccccctcctggagccttgcggctgtgtgggaagcctgcagtttgttcatcaagagtgcctgaaaaagtggctgaaagtgaaaataacatcaggagcagatcttggtgccgtgaagacctgtgagatgtgtaagcaaggcctgctggttgacctgggtgactttaacatgattgagttctaccagaagcaccagcaatctcaggcacaaaacgagctgatgaattcaggcttgtacctggtgctgctgcttcacctctatgagcagaggtttgcagaactcatgaggctcaaccacaaccaggtggaaagagagaggttgtcaagaaattacccacaacccagaacagaggaaaatgaaagtaggttttgggggccagtcctgccattttgagggtgtttgctaaattactctttttctgtgactgtgtggaaccaaatgccatggaaggaaggaatgaccaccacccagaggcaaaaataaccccgcaaagcttgggaaagtcagccgcagcaaacaatcaggaaggcgaggccaagttcactggatgcagagcagataagaattttaattcatcctgaacgcaaggaaaggcgccaacaaagggaagaggttatcttccggcatgagataagatttgttccttttccttgctgggattctccagcgtccagcacttggagagtttgggggttggtttttttactgccaggattcctctaggaaaaccctccccaagccctggcaggggctgtctggcccttacctgaagggaccacattcactcacaagctagtggccttggtggatttggggtctgctgaattcagaggttgaacaaagcaaacaggtctcccaagaaagggccctcaaagcgggcaagacggctctctgcaaacaggttcgagaaaagccttctccctgttcctttttccatt

SEQ ID NO: 17743 - DNA, 1757 bp, Homo sapiens
agagccgagccggcggctccaccgaacggccgcgcctgccgccgccgcagctgcagaaccttccgcatcccctccccgtcccgccccctagccccaggcgtccgggccccctccctccttttcccctctccctcccgccccctccgcgctctctttccctgcagccagagcccggcccgccagccgggccggcaggagggcggcggcggcacaaccatgagctttgagggcggccacggcggcagtcggtgtcgcggggcggagagcggggacgccgagcctcccccgcaacctcccccgccgccgccgccgacgccgccgccgggagagccggccccggtccccgcggccccgcgctacctgccgccgctgcccgcgtcccccgagacccccgagcgcgccgcggggccaagcgagccgctaggggaggtggccccgcggtgcaggggagcggacgagctgccgcctccgcccctgcccctgcagcccgccggccaggaagtggcggcggccggcgactccggggaaggtccgaggcgcctcccggaggcggcagcagcgaaaggcggccccggggagtctgaggccggcgcgggcggcgagcgcgagcggcggggcgccggagaccagcccgagacgcgctcggtgtgcagcagccgcagcagcagcagtggcggcggcgaccagcgcgctgggcaccagcaccagcaccaccagcccatctgcaagatctgcttccagggcgcggagcagggtgagttgttgaacccctgccgatgtgatgggtcagttcggtatacacatcagctgtgcctgctaaaatggatcagtgagagaggttcctggacctgtgaactttgctgttatagataccatgttatagccattaaaatgaaacaaccttgccagtggcagagcatttctataacactggttgagaaagttcagatgattgctgtaatcctaggatccctgttcttaatagccagtgtgacttggctcctctggtcagccttcagcccctatgcagtgtggcagaggaaggacatcctttttcagatctgctatggaatgtatggttttatggatctagtgtgcataggtctcattgttcatgaaggagctgcagtttacagagtgtttaagcgctggcgagctgtgaatttgcactgggatgtgttaaattatgacaaagccacagacatcgaagaaagcagccggggagagtcttccacaagtaggactttgtggttgccattgacagctctgcggaacagaaacttggtccacccaactcagttaacctcaccaaggtttcagtgtggctatgtgttattgcacctgttcaatcggatgaggccccatgaagacttatcagaagataacagctcgggggaggttgtgatgagagtgacttcagtgtgacaaaagcataagatgatgcagtgtggaccaccctgcacattttgcaatgtaattgcagtgaatggcaaaaccatagcacttctaaaaacacatctatgaactttttaaaatttatgctttttatatgaacatttgaattgcaaatacatttttctgagaaaaagagtcctcttgttcttcgttgtctggtttgtcacatcttttataagttggtacttgaaatcattatacatataatttaactatacttggttaaaagaataatgaaagttatccttaaggccaaaactattttttcttgcttgttttaaatatatttttatgaaagcttt

SEQ ID NO: 17744 - DNA, 1376 bp, Homo sapiens
ccggacgcaggtgccggccggagcggagctagtggcgccgacgggccgggccgggccgggaccggggccgaggcgaaccgaggggcctgtgcggccgcccggcccggccgcggatcaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggctttcctcatctaacaccagctactgcgagctgtgccacacggagtttgcagtggagaaacggcctcgacccctcacagagtggctgaaggacccggggccgcggacggagaagcggacactgtgctgcgacatggtgtgtttcctgttcatcacaccgctggccgccatctcaggctggttgtgcctgcgcggggcccaggaccacctccggctccacagccagctggaggccgtgggtctcattgccctcaccatcgccctcttcaccatctatgtcctctggacgctggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcagagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccctggctgg

SEQ ID NO: 17745 - DNA, 1166 bp, Homo sapiens
ccggacgcaggtgccggccggagcggagctagtggcgccgacgggccgggccgggccgggaccggggccgaggcgaaccgaggggcctgtgcggccgcccggcccggccgcggatcaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggctttcctcatctaacaccagctactgcgagctgtgccacacggagtttgcagtggagaaacggcctcgacccctcacagaggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcagagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccctggctgg

SEQ ID NO: 17746 - DNA, 1647 bp, Homo sapiens
ccggacgcaggtgccggccggagcggagctagtggcgccgacgggccgggccgggccgggaccggggccgaggcgaaccgaggggcctgtgcggccgcccggcccggccgcggatcagagactggagactgggtcttgctctgttacccaggctggagtgcagtggtgtgatcatagctcactacagccttgaactcctgggctcaagaggttgaggctccctcctcagcctcccaagtagctgggactacaggctttcagcaccatgcctggctaattcaaaaaaaccttcagagagatagggtctctctatgttgccctagctcgtctcaaactcctggcctcaagtgatcctcctgcttggacctcccaaagcgctgggattacaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggctttcctcatctaacaccagctactgcgagctgtgccacacggagtttgcagtggagaaacggcctcgacccctcacagagtggctgaaggacccggggccgcggacggagaagcggacactgtgctgcgacatggtgtgtttcctgttcatcacaccgctggccgccatctcaggctggttgtgcctgcgcggggcccaggaccacctccggctccacagccagctggaggccgtgggtctcattgccctcaccatcgccctcttcaccatctatgtcctctggacgctggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcagagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccctggctgg

SEQ ID NO: 17747 - DNA, 4196 bp, Homo sapiens
gagtcccgcagcgcccgccggcagccacggcacttcgcaataaccaacttccccgccgccggcgcgtcccgccagcctgccctcggccgcaggcgactggacggcggttacggggcggtcccagcgccaccacgactggctgtcggctccgccagtcatgggctgatgacgccccggggctggctccgcccctagcggcagccccgcctcccctccagagcctggtcggcttagccctgctttccgcctcactcgttgagcaggtccgtgaattgtcagcgcgctgtgggcgactgtgtggccgcggcggccgccaggcttgccgcactccccctgaggtgcccgccggaaccaatgtgccctggtccactgggccgtgagcagccaccgactgggggcaacttggcacttagaaccgcagcagggacgtcggtttgctatcgggactcggcgaggacgatggaaatcctgtatgaatgtggaagccattagcagagtaattgctgtctgttaccatgacaaccagccgctgcagtcacctgcccgaagtcctgccagactgcaccagctcagctgcacccgtggtgaagacggtggaggattgtggcagcctagtgaatgggcagccgcagtatgtcatgcaagtttcagccaaggacgggcagctgctgtcaacagtagtgcggactcttgccacccagagccccttcaatgaccggccgatgtgcaggatctgccacgagggcagcagccaagaggacttgctctctccatgtgaatgtacagggaccttggggacaattcatcggagctgcctggagcactggctgtcatcctcaaacaccagctactgtgaactctgccacttcaggtttgcagtcgagcgcaaacccaggccgttagtggagtggctgagaaaccctggcccccagcatgagaagcggactctgtttggcgacatggtgtgcttcttgtttataactcccctggccaccatctcgggctggctgtgcctgcggggcgccgtggaccacctgcactttagtagtcggctggaagccgtcggactgattgcactcactgtcgcactcttcactatttacctcttttggacactagtgtcatttaggtaccactgtcgattgtacaacgagtggcgtcggaccaatcagagggtgattctcctcattccaaagtctgtcaatgtaccttctaaccagccgtccttgctgggcctccattcggtcaagaggaactcaaaggagacagttgtttgatgtttgtatggttggttggttgtttgattcattgtttggggtttggaagtgtctgcactggggtcatgcactgagcgacccccaagcccttccttaagcctgtgggtctaagaacatccagagcatattagcacatcactccaagcaacaacctccgccagaagaaagcaaatgctgttttacttcaaatgatggatgctgcaatcatatgatatttgctaagctgccaaacatgtttatttagcagatactgtatggaattttctgaacacctctttaacgtatgaggaaggttgtcctgctacggatgcaattcaattcttccttttttattactatttcaaacacacacacatatatatatatattaaacttagatgataatcaaaatcaaaaagtcaacgtaaaaactggtttcttggtttggttgggtcttatttgagttagtttgtttctcagtttctcgtatggattctttggggtactttggtagcctgagtggtctttttcatctctttcgcgtccattactcaaggagacagcataacagatgcagaacaagtcatatttgaagaatgttttgtactaaacttcatttaattattcagtttttaaagggaaaaagggcgtgagctcacacagtgagctgtttatttaaatatcattaaggagaaaaaaaaatatggtgagaagctcgctcctttcaacttgtttggtactgacagctgatagaagctattttctaataataaacatccagtgtgtgaaagacaaaacccactgattgcaatactctttttttaatgataaaacctgtgaagtttcccaaagcaggttttaaaaggaaaaaaaggaaaagcaaaaaggttgctgttctcactcccatctcatttagtgcatgtcttaattcgggattcgtaatgaattggaggatcattagacatttctaggaaccctagacctgttttgcatgtcaattagcattcccattgctctattgaatttctagcttgacaggtagatgtggcaaaaaaaaaaaaaaaaaaaaaagcctgtcctagcagccctgcacttattctaagacccctttgtctgattctttaaaaaggagccccacacagtgccttcccccaaccatgagccaattctgtcacagtccgaaatagactttttctaagggtttcgtgtccctcttttatccgtcgcagtgtaaagggtctgatccgcagcctgcattgtgcgcgcaccgaggcaggagcggatgtcttctgaggagagcgctggctggggttgactctcaggctcccggctgtccgcccgcccacacgcagcgaggaggggcggagccctgcttccggaatgcttaaaatatggaattctagaacatgacccacattctgagtatcactccagcatctgccttgtgttccaagtgggaaaacgagaagtgcaaaggaacaggcagcgaggagggtagcgatttttgtctgcaaattgatggagctgatgcaggtgtcccctttgtaggcgagccctccattcactggctgctcccagcgctgcctggggagggaaacagctgtactgctctccgctgcaaaactcagatgtgctttatggcttgtgacaatagatttcctccccaccacgcttcactgggacacttcaattccagtaatatatgtctcagcccttctgtttactgcgccctgctcacccccctgggctgtcattagctgcaccaccatcaaccgtttcttaattgacctttttaaaatgctggacatcaccggctgcacgcagctgccacacattaaatttccagagcaaagagtccaacttggtagctggtgaattgcagccctgtaatatacttaataaatgacgtccacccagccttagtccctgagctgtcaggtgaacccgtgacacgtctcaactgaatggcacaacattcatgagaggaccataccccttctccctgtttcttgcatgaattaaggaagcagcggatttccaggatgatttcctgtcaaggttggctgcagagaattcctgccatcttggttcatgagatgagatatgacatcatcaaaggcagccaggtcccaggccgttcaatggggatcctgcattaggaagggtttgcacattaaaactgtgcctgtgccacacctctttccttcgtgtttgcatccctgccctgtgaagtaaaacagagtccaagatgcaaggagtagattgtgtgtggggtggtgaaaggacacccctggcagccaggcagagcatcagtgcctcccttcccaggtcaccagcttgggacctccttgtgagaggctctgatctccatcagcatcagggcccataggggattctgaactcttggaggatatttcatcccctccaagccttgccccatggaaagggctacacctcctgcaggaaggggtgccttttgttaacaggtattaatgggtacagaggcaccatgcagcctaccagcacccttgctagcctagtcctcttcctgtgcttctttttgaaagatcaagaatgaagaggaagagatgaggagtgggggtcctttacctaaaggaccctcgtggttcattgcttctctttaactgactttttaaaaaaactccctcttccacactccttgctgtgattctgtcctaatcatttttcttgagaatgtcatgtagagataaatgtgtgtcacagtgaagccagaaggtgaattaacaactaagacaaatccagcatgctcttgcctgccctgcatatgtgctcatttggggaaggacggaggacacagagcatcgacacaaattctacagctcctcagagaacacagcagagactcagatgagctgtaaaatccattaaggaaaaataaatggcatgatttggaagtta

SEQ ID NO: 17748 - DNA, 4447 bp, Homo sapiens
cccacctcggccacactgcttcgctcccccctccccaccttcagctggcaccgcaaacaagccttacctcgttgcatctgcgaggagaggtagcaacagcgagcctagccagccagaggcggtggagaggaggaaggggcggggtgggggggcagagagcgggccgaggccgcccttggtgggggtagcgggggcagagctgccgagcagacccggcagccgccctcctccgcccccaccctccagaagcactcttgcctgagaaccgaattattccactagtattatttcattttttattactccccctcctcactccccagccgcccccacccccacgccggcctcgcctctggttgcatggcagcgctgcccgggcgcgggggctcagggctggcccccagggaagggggaggaggaggaggatcatgaaggccggagtcgcgaccgcgccggacggcgggcagcagccagaggacgagccggagcagcccccgccccggagacacccggacgccgagcagcagtcgcctccgccgccgcagcagcagctgcgggcgcgggccgacccggagccggaggaggagggcgaccgcgacccagaggaggaagaggaggagaaggcgaggccactcgcccgcccggacctgcccttctctcggctcttgcccctcgaccgaagggacctttgatggaaccgaggggagggcgccacggatttgccgactgcagcaggggtgggctgggggctgagataatgtaaccactcctttctcctgttctctcccacacgcccctctcctctacccctattctctgctccactgccctctcaccccggtacacacacccttcctctagccaggatcttcatgctcaggaaggaggcgcctctgcaagggttaaacgatcttttctttttctcccatcctttttccttcccaaacctctattttacctcccttctcctaattggctttcccctcttcggtgtaaccctttggctgcggaggcaaagcacaagcccctagcccagtttcacctgcaacacccctcccccacccaactgctctcttaaaagcaactctggtgcttctgggggttaattgccccagttttctgcccaggagaattaaaacttctcccaatcttctctcctcccctaccttgactcccccaacccctaccacctgagaaaaacgatcttttctctctcacacatgcagtcctcaattcttcattgagctagttttctctaagcccagctcaatccactccagatttgatttacaattgtccccacccttttatataaaagaaagatttctcactgcgtaggaatttgagaagaacccaataatcctttcctggggaacttttaaacaattcgacattgatttaaacaattcgacagaggctctagtggcccctccaccacgcttcttcaatccctctgctcctaccagtgtcctcaggtcaaaagcagaaaggagacacactgaacaaagttggaggttggggtgggtgtgtgagggcaagaaaaacttttttgttattgggctttccaggtggagttcagaaccagtgactcacacttctcagtcctgggagcaatttatttgctacttggaggggttgtaagaaaagccagtgagaaagcagactccccccacaacacagatccactgtggacccccaaaacctgtcctgtccccctcttttaagactccagccacccctcttgggctctctacttccacggggcacatgctgatgcccctgtgtgggctgctctggtggtggtggtgctgctgctccggctggtactgctatggattgtgtgccccagccccccagatgttgcgccaccagggtctcctcaagtgccgctgccgcatgctcttcaatgacctgaaggttttcttactgcggcgccctcctcaagcgcccctgcccatgcacggcgacccccagccccccggtttggcggccaacaacacccttccggctctgggcgccggggggtgggcaggctggaggggcccccgagaagtggtgggcagggagccccctcctgtgccacctccaccccccttgccaccttcttctgtggaagatgactggggtggcccagccacagagccacctgcctcgctgctcagcagtgcctcctcagatgacttctgtaaggagaagaccgaggatcgctactcactgggcagcagcttggacagtggtatgaggaccccactctgccgcatctgcttccaggggccagaacagggggagctgctgagcccatgccgctgtgatggctcggtcaagtgcacacaccagccttgcctcatcaagtggatcagcgagcggggctgctggagctgcgagctgtgctactacaagtaccacgtcatcgccataagcacaaaaaatcctctgcagtggcaggccatctctctgacggtcattgagaaggttcaggttgcagccgccatcctgggctccctcttcctcatcgccagtatttcttggctcatctggtcaactttcagcccctcggcaagatggcagcgccaagaccttctcttccagatctgctacgggatgtatggcttcatggacgtggtgtgcataggtctcatcatccatgaaggaccctcggtgtaccgcatctttaaacggtggcaggctgtcaaccagcagtggaaagtgctgaactatgacaagacaaaagacctggaggatcaaaaggcaggaggcaggaccaacccccggacctcctcatccacccaggccaatatcccctcctcggaagaggagaccgcaggcacccctgcccctgagcagggccctgcccaggctgccggccacccctcaggccctctgtcccatcaccactgtgcttataccatcctgcacatcctgagtcacttgagacctcatgaacagcgaagtcccccaggcagcagccgagagctggtcatgagagtcacgacagtgtgagagcagaggcccggaaggaaggccatgaccaccactgagggcccggagcagggtggggaggtgcagtggcacccccagagccaacagagggagcaggcagagggtgggggacctggcgggagccctggggtagtgtcagagcgggagtgaggctggtgcaggagcagttctgctatttccaatcagtcaatgccactctccacaacaacaatgaaaaccaacaccaactcaacaacaaagtgcaatacaggctgaacctggcccaacagaaaaaccctgccccaatgcacctgcaggcaaggtacccgaagaagcagaggctgagggcaggcaaagcctgtgtgactgtggcagtgccggaggccaagggggccaagaggaaaagcatctgtggtctgctctgctctcaccctgtttggttttgtttctcctggggctgtgttctgcaggcagccagaaaaggaggaggcacgggtgagctggcagggacacactgcctttggggctcctgggctcatttggatgggcaagattcgctgacaaatggctgtggggatggtggggtggatggtcagggagggatgctcagggagggatatgctggtgtgagcagccagagggagagtgtgtctccttcctgaaggaacttccaaatggaactcccgatttcaggtgggctaaaagagggcttaggtttggaaaagggtgtccttctgtgcccttgttaatttattttatagtgatttggttcaaagatgtttacaggacacacacacacacacacacacacacacacacacacacccctagagaaaagtacagatttccagtggatatttcaagcacagttctgctgctgtggcttcagctttggaagctgtcaatcccggagcaactttcccaactacccaaccccaccatggccaggacatgtgcaatgccagccccttcttgtcttggcacatgcacagacccagtcccctcacggtagggcacccctgacctacgggcttccaagagagcagctgcagtggttgggaggagcttgaccagtgtgccccaaggagtggagtagagcccaatctaagtattccttgctgcttggaaccctccctgtttggaaccctccccaaagaggcagtcaggctgatgctcagtgctttgtgctccctgctccttcccgcgtagccaggtgggcccaagggtgcctggcagggagcactacccctggacccctcctgctcgctctggggaccctgccagggaaggccactgggtgttcacctgcaaagtttctggttgtcactgcacagtggtcgcgtcatccatgggtattaaaaggacactgtcaagtacttttttaaactagtttttagggttttttaaaactctctgttgtttgtaatattctcttaaaagcttgaaaataaaacttctttccctacca

SEQ ID NO: 17749 - DNA, 3926 bp, Homo sapiens
tcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttc

SEQ ID NO: 17750 - DNA, 4560 bp, Homo sapiens
cctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattgg

SEQ ID NO: 17751 - DNA, 3743 bp, Homo sapiens
ggtggctggttctgcgccggatccgggagaggggcgggcgccattgtgcttcgctgccgactgcatttcctcagtcacgggcctagaactccaaggagaaaggcggcgaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggactccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccctccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttactgtttgaaatgtttccttttaaactggtgctcaaagaagacatcagacttcataaccaagaattttattacaatttcaaatctcattttaagcaataatataaatgttctaaaacatttgctcacctcttgccagttacctttgcattgtctgtcttaaagcaaaaatataaaatttaagggtggtagttttaatatattctgtgggtcctaagggatgctttgaatttgaagtatatatacttttaataaaattcagtatgacagttg

SEQ ID NO: 17752 - DNA, 2402 bp, Homo sapiens
acttaacggtggtggctggttctgcgccggatccgggagaggggcgggcgccattgtgcttcgctgccgactgcatttcctcagtcacgggcctagaactccaaggagaaaggcggcggaattcatgatttgttcctgtagctgaaacatacattgaatgctttctgccctggcatgaacttacatggtcagagctggtttttcctgccctcaaatatatttctctgactctaccggttagactagaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggactccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccctccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctg

SEQ ID NO: 17753 - DNA, 559 bp, Homo sapiens
gttctgcgccggatccgggagaggggcgggcgccattgtgcttcgctgccgactgcatttcctcagtcacgggcctagaactccaaggagaaaggcggcggtgcgtgttgctgcgagtgggacgcgcactggtcggtgccggctcaggagccgggctttctgccctggcatgaacttacatggtcagagctggtttttcctgccctcaaatatatttctctgactctaccggttagactagaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacct

SEQ ID NO: 17754 - DNA, 2370 bp, Homo sapiens
acttaacggtggtggctggttctgcgccggatccgggagaggggcgggcgccattgtgcttcgctgccgactgcatttcctcagtcacgggcctagaactccaaggagaaaggcggcgaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagatgttcaagacagagttccttcatattcacaaggagcaagaccaaaagaaaactcaatgagcactttacagttgaatacatcatccacaaaccaccaattgccttctgaacatcagaccatactaagttctagggactccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccctccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatattta

SEQ ID NO: 17755 - DNA, 2496 bp, Homo sapiens
ctcggtgtcctcccgcggaggggcgtagggtgtaaacaggcgacgcgctgggggaggtgcggccttgctgcgtccacgtctcgggcatgctcgaggcgggccagggcggtagcgccgccagctcagagcccacctgaggtaactcctgcggcctctaggatcggagtcccccacgccgcgcgcagccgccgccgctggccgccaataagggcggccgagcccccggcccgggcagggggtgtggctgccggcagcgcgtcggctacaggtgggctgggctgggctgggctgggctgggctgggtgggggcggccgccaaggacccatccctgcgctgcgggcccggcgtggagcccgcggagaggcagcgcgactccaggcagtgggtctctctgccccggtgctcgcgtctgcccctggggccgggccgagcggaaccaggaatcgcagaaacggtcagcgcccagggctctaggccggccgccccgggtgccaggtgaattcctttccctgaccggctgtgagacgttggcccgtcagccgtcgtctttggcctgagtgtgcacatctgtaaaatggaagctcggactagtgatccgtgaggaccttccacgtctgacgtgtgatctcgagagacctgcgtacattcggggtgccagaaggaaagcatagcttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgc

SEQ ID NO: 17756 - DNA, 1848 bp, Homo sapiens
atggtaggtatagggctgtggatatcgtcagtttgaccaagtattccaagaggccccatggagtttgtcatctgtaatagaggacgttagtgcattagtgatgaaaaaactgcttaccactgactattgtgatctcccagggagtataaggcagctccgcacttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaa

SEQ ID NO: 17757 - DNA, 2589 bp, Homo sapiens
ctcggtgtcctcccgcggaggggcgtagggtgtaaacaggcgacgcgctgggggaggtgcggccttgctgcgtccacgtctcgggcatgctcgaggcgggccagggcggtagcgccgccagctcagagcccacctgaggtaactcctgcggcctctaggatcggagtcccccacgccgcgcgcagccgccgccgctggccgccaataagggcggccgagcccccggcccgggcagggggtgtggctgccggcagcgcgtcggctacaggtgggctgggctgggctgggctgggctgggctgggtgggggcggccgccaaggacccatccctgcgctgcgggcccggcgtggagcccgcggagaggcagcgcgactccaggcagtgggtctctctgccccggtgctcgcgtctgcccctggggccgggccgagcggaaccaggaatcgcagaaacggtcagcgcccagggctctaggccggccgccccgggtgccaggtgaattcctttccctgaccggctgtgagacgttggcccgtcagccgtcgtctttggcctgagtgtgcacatctgtaaaatggaagctcggactagtgatccgtgaggaccttccacgtctgacgtgtgatctcgagagacctgcgtacattcggggtgccagaaggaaagcatagagatggggtcttgctgtgttgcccagactggtctcaaactcctggcctcaagtgatccttctgcctcagcttcccaaagtactgggattacagcttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgc

SEQ ID NO: 17758 - DNA, 5021 bp, Homo sapiens
tatctgtaaggacacattacaggcgtcaaagagaaattcctttggttcagaatgggcccaggccttgaagcctgctaagaataccaaagccagaagaacactaaagttctcaaggtccctcaatgatgtgggtgagaaggcgcaggatacttcagaaagttttgcctatgtggaaagaacttgttctgaagggaaattaatactccctcaagatacgtgtctcagaactaacaggtttcatcataaagaaaaaagaaccctgaaccacaaacctcttggcaattccaaacattcttgtgtttcatgcctttctgccggtcgctcaactgcctcagaggtggaagctggcaaggggggcaggcccggcctgctgctggaagagaaggcggatggtgaggccacgtcccgaagccggcaactgctccagtacctgttctcactctcgcacggcttgagcgccagcagcctgcacaggttccatgagctggagagctgcgctgctcgcctgcacactgccaagtcctccagcgggctggcagggagtatgggcttctgctctgacgagatgggagacgacgatgtctttgaggacagcacatctgcaaaactgaagagtagggttctgcgggcgcccctctgctccacggaaaaggacagcgacctggattgtccttctcccttctctgaaaaattaccccccatatctcccgtgtccacgtcaggggatgtctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaag

SEQ ID NO: 17759 - DNA, 441 bp, Homo sapiens
agtagagacagggtttcaccgtgttagccagggtggtctcgatctcctgacctcgtgatttgcccgccttggcctcccaaagtgctgggattacagcttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgat

SEQ ID NO: 17760 - DNA, 2982 bp, Homo sapiens
gaaggagccgccatttgccaccgccgagcgcacgggccgagccaagcctgatcccggagccggagggggactgggaccgagagaacggcgatggggggcggccccgccgcaggaggacccgggcgcgtaaccccgggggcccggcccgctccagacccagacccgcggggtgcggcaccctgagcccccctccccgccccctgccctggccatggccgcccaccccgccgcccccgggccgccagcccgctcggccccgcaagcaccggagccccggcggtggcagcagtgaacggctgtcgcaggccccgaagaccccggcccggctcggctctctagcgcgcgcccccttcccggccttgtcctctcccctccccccgccgctagcgagccccccttgcacgctgccccccgcccccggtgtccggacgatgctcaagtctcggctccgcatgtttctgaacgagctgaagctgctggtgctgacaggcggggggcggccccgggccgagccgcaaccccgggggggccggggaggcggctgcggctgggcgcccttcgctggctgctccacccgggacggcgacggcgacgaggaggagtactacgggtcggagccgcgggcccggggcctggccggcgacaaggagccgcgggccggacccctgccgccgcccgcgccgccgctgccgcccccgggcgcgctggacgccctgtcgctcagcagtagcctggacagcggactccgaacccctcagtgccggatctgcttccagggcccggagcagggggagctcttaagcccctgccgctgcgacggctcagtgcgctgcacgcatcagccctgcctcatccgctggatcagcgagaggggctcctggagctgtgagctctgctacttcaagtaccaggtcctggcgatcagcaccaagaacccactgcagtggcaggccatctccctgacggtcatcgagaaggtccagattgctgccatagttctgggctcgctcttcctggttgccagcatctcctggctcatctggtcctcactcagcccttcagccaagtggcaacgacaggatctgctctttcagatctgctacggcatgtatggcttcatggatgtcgtctgcataggcctcatcatccatgaaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacgagccgccccccagctgcccagcgcatgcggacgctcttgcctcagcgctgcggttatacaatcttgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgcacgtggagactcctttctcatctggggcttttctggagggttgggagatgtggggaggtttctctgcacaggttgcaaatcccaaatgcagcagtgggttctgagttgtaggtgtgactcccacttgctggtgaataattcatgttggctgctaggtggcagcactccgaggtatctaaagggtagacctggacctgccacctatgagttgtgtgatatagaaaaaaatctcttagctctggttttcctgtctacttcatagggttggaataaggataaatgagggacaggttggatgccgttgcagagaaaatcagcaatgacataaagagatttctagaatagttgatggtccatttatttcaaatagtagctggtgtaacaaattctaaaatgtgtttttcatctggagttgcacagaatcatggaattttgtgttgagtgacataataggtatggaaatatgaggggaaatagacattgcaaatgtgaagcatggtggttatttgttaagaatgagaactcctctgactctaaatatttgggcctgtgggctggggaaggctggagccatctgccttgttctggagatcatctgggttctatcagtccttctcaagtactgtgctcacccagaaaagcagtgtgaagtgaatttggactcatttggagtgagatggagggaatccccccactcagtgttatgagtctccaaccccagtttaagctatttccatggcagtttagggtcacaggtttgatcccggtgtgcccagccagtggtattaatggatggcattatgtttggaggcagcagcatagaggactgttgtttatagagaaaagatttgggaaggactgtttacaatgtgggtcagcctgaagcctgggcactttcttctgtgaccttggggttgtgtattatatgaatgatgctgtttttaagtaaaccattcaacagcaattaaataattccttcattcacggctaaa

SEQ ID NO: 17761 - DNA, 1668 bp, Homo sapiens
actaagaatacaaaaattagccaggcgtggtggctcgtgcctgtaagctactcgcgaagctgaggcgggagaatccttgaacccgggaggcagaggttgcagtgagccgagatcacagccactgcactccagcctgggcaacagagcaagactccgtctcgaaggaaaaaaaaaaaaaagaaaagaaaaaatgatgttgatgatgatagcaaatatgtagtgttttctgtgtcaagttttggtgtgtattaactcttaatcttcacaataatcttattagatactattattatccccttttacaaacgaggacactgatgcacaaagatttgaaaacttacccaaggttacttagccagtaagtgatggagtcaagatttaggattcaaatctagatgttttggtttcagagcacttgcccaatcctgcctttctaaagtaagacaaatggtgtcagacaagtgccacattctagatttaatcaaggcacagagaagacagatgttgatcctgcctgaaggttttagggaaggttcctggagcaccctgctcttcagggccacccatcacctggccctccatccctttctgggactctttggagccctttctcccacacagtggcaggccatctccctgacggtcatcgagaaggtccagattgctgccatagttctgggctcgctcttcctggttgccagcatctcctggctcatctggtcctcactcagcccttcagccaagtggcaacgacaggatctgctctttcagatctgctacggcatgtatggcttcatggatgtcgtctgcataggcctcatcatccatgaaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacgagccgccccccagctgcccagcgcatgcggacgctcttgcctcagcgctgcggttatacaatcttgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgca

SEQ ID NO: 17762 - DNA, 4380 bp, Homo sapiens
cagagcgcgcacgcaagccccgggagcgcgggacagacagggcacgctgggtcggcggagctgaggctcccagctgtgggcctcgctggcccggtcgcccagtctcgcgagagttgggagtaaacagccccgaatggagtgcccaggcgtgttcgccgcggaggcgccgttatcccgggcccgccggccctgagctcccggcggcgcagattggctcacagtggttgattgatcaaccccattggacgttggttctgtggtacaaatggagtacaggactcagtcgtcacggcctgagtgagagaagccttatttccaagatggagaagaagcggagaaagaaatgaaagcctctcttcaggctgaaccacaaaaggccatgggatttaacttttatttatgttgggcaagactgtaagatggctgattagtaatgttgcagcttttagctgaaacaaaaattcacttttaatcaagaagaaaaaagtgtgatttgaatatatgcaattttatgatcatattcgcttgtgaccatgaagcttgtcaacatctggctgcttctgctcgtggttttgctctgtgggaagaaacatctgggcgacagactggaaaagaaatcttttgaaaaggccccatgccctggctgttcccacctgactttgaaggtggaattctcatcaacagttgtggaatatgaatatattgtggctttcaatggatactttacagccaaagctagaaattcatttatttcaagtgccctgaagagcagtgaagtagacaattggagaattatacctcgaaacaatccatccagtgactaccctagtgattttgaggtgattcagataaaagaaaaacagaaagcggggctgctaacacttgaagatcatccaaacatcaaacgggtcacgccccaacgaaaagtctttcgttccctcaagtatgctgaatctgaccccacagtaccctgcaatgaaacccggtggagccagaagtggcaatcatcacgtcccctgcgaagagccagcctctccctgggctctggcttctggcatgctacgggaaggcattcgagcagacggctgctgagagccatcccgcgccaggttgcccagacactgcaggcagatgtgctctggcagatgggatatacaggtgctaatgtaagagttgctgtttttgacactgggctgagcgagaagcatccccacttcaaaaatgtgaaggagagaaccaactggaccaacgagcgaacgctggacgatgggttgggccatggcacattcgtggcaggtgtgatagccagcatgagggagtgccaaggatttgctccagatgcagaacttcacattttcagggtctttaccaataatcaggtatcttacacatcttggtttttggacgccttcaactatgccattttaaagaagatcgacgtgttaaacctcagcatcggcggcccggacttcatggatcatccgtttgttgacaaggtgtgggaattaacagctaacaatgtaatcatggtttctgctattggcaatgacggacctctttatggcactctgaataaccctgctgatcaaatggatgtgattggagtaggcggcattgactttgaagataacatcgcccgcttttcttcaaggggaatgactacctgggagctaccaggaggctacggtcgcatgaaacctgacattgtcacctatggtgctggcgtgcggggttctggcgtgaaaggggggtgccgggccctctcagggaccagtgttgcttctccagtggttgcaggtgctgtcaccttgttagtgagcacagtccagaagcgtgagctggtgaatcccgccagtatgaagcaggccctgatcgcgtcagcccggaggctccccggggtcaacatgtttgagcaaggccacggcaagctcgatctgctcagagcctatcagatcctcaacagctacaagccacaggcaagtttgagccccagctacatagatctgactgagtgtccctacatgtggccctactgctcccagcccatctactatggaggaatgccgacagttgttaatgtcaccatcctcaacggcatgggagtcacaggaagaattgtagataagcctgactggcagccctatttgccacagaacggagacaacattgaagttgccttctcctactcctcggtcttatggccttggtcgggctacctggccatctccatttctgtgaccaagaaagcggcttcctgggaaggcattgctcagggccatgtcatgatcactgtggcttccccagcagagacagagtcaaaaaatggtgcagaacagacttcaacagtaaagctccccattaaggtgaagataattcctactcccccgcgaagcaagagagttctctgggatcagtaccacaacctccgctatccacctggctatttccccagggataatttaaggatgaagaatgaccctttagactggaatggtgatcacatccacaccaatttcagggatatgtaccagcatctgagaagcatgggctactttgtagaggtcctcggggcccccttcacgtgttttgatgccagtcagtatggcactttgctgatggtggacagtgaggaggagtacttccctgaagagatcgccaagctccggagggacgtggacaacggcctctcgctcgtcatcttcagtgactggtacaacacttctgttatgagaaaagtgaagttttatgatgaaaacacaaggcagtggtggatgccggataccggaggagctaacatcccagctctgaatgagctgctgtctgtgtggaacatggggttcagcgatggcctgtatgaaggggagttcaccctggccaaccatgacatgtattatgcgtcagggtgcagcatcgcgaagtttccagaagatggcgtcgtgataacacagactttcaaggaccaaggattggaggttttaaagcaggaaacagcagttgttgaaaacgtccccattttgggactttatcagattccagctgagggtggaggccggattgtactgtatggggactccaattgcttggatgacagtcaccgacagaaggactgcttttggcttctggatgccctcctccagtacacatcgtatggggtgacaccgcctagcctcagtcactctgggaaccgccagcgccctcccagtggagcaggctcagtcactccagagaggatggaaggaaaccatcttcatcggtactccaaggttctggaggcccatttgggagacccaaaacctcggcctctaccagcctgtccacgcttgtcttgggccaagccacagcctttaaacgagacggcgcccagtaacctttggaaacatcagaagctactctccattgacctggacaaggtggtgttacccaactttcgatcgaatcgccctcaagtgaggcccttgtcccctggagagagcggcgcctgggacattcctggagggatcatgcctggccgctacaaccaggaggtgggccagaccattcctgtctttgccttcctgggagccatggtggtcctggccttctttgtggtacaaatcaacaaggccaagagcaggccgaagcggaggaagcccagggtgaagcgcccgcagctcatgcagcaggttcacccgccaaagaccccttcggtgtgaccggcagcctggctgaccgtgagggccagagagagccttcacggacggcgctggtgggtgagccgagctgtggtggcggctggtttaaaagggatccagtttccagctgcaggtttgttagagtctgttctacatgggcctgccctcctgtgatgggcagaggctcctggtacatcgagaagattcctgtggatcccgtcaggagggacttagtggctctgccgccagtgagacttcccgccggcagctgtgcgcaccaaagactcgggagaactggaaaggctgtctggggtcttctgactgcaggggaaggatgtactttccaaacaaatgatacaaccctgaccaagctaaaagacgcttgttaaaggctattttctatatttattgttgggaaaagtcactttaaagacttgtgctatttggaagcaaagctattttttttgtcagtggaatgcagtttttttactattccatcatgaggaacaacatagattccatgatctttttaatgacagtacagactgagatttgaaggaaacatgcacaaatctgtaaaacatagaccttcgctttatttttgtaagtatcacctgccaccatgttttgtaatttgaggtcttgatttcaccattgtcggtgaagaaaattttcaataaatatgtattacccgtctgaagcttaaaga

SEQ ID NO: 17763 - DNA, 3085 bp, Homo sapiens
aacccaacacaaactcagttcagataaggggaaaccatgaaaccaacataattgccagagcacttgtgtcagcacttctgacacaaattatgtcagggtccccagcacctctcccaggctcggtgctttagggctcacgggactcagcctgtggtcatactcccagctaagattcattatagtggcacagcaaggatgcacagcggctctgtaagggaaaaagatgcctcacacggagaaagcctggagaaatccaggcgcagcttcctaagctctcccctctctcctgccaggcagggtctcacagagctggcccctttcctagcagcaagctgcattgacatgtgtacgtgtttttgcccagggaagccctctagagactcaagtccaagtttccattagggctggtcacgtactcattctctgccagtgacaactcccaaagctccagacttgcaaaagcagaggtgtccctgcacatcacactgtctgtatagacagcaggctggcacagaggccttatctgtgcaggagcattccagagccaagttcccagatgccagcctagggcagcgctgtaagcaagcccttctgaagctaggtctgctttgttaactctgtcttgtacagttgtgttgcttcattgtagttttctcatatgatctactctaacactgtattctttatttcagtttgagccccagctacatagatctgactgagtgtccctacatgtggccctactgctcccagcccatctactatggaggaatgccgacagttgttaatgtcaccatcctcaacggcatgggagtcacaggaagaattgtagataagcctgactggcagccctatttgccacagaacggagacaacattgaagttgccttctcctactcctcggtcttatggccttggtcgggctacctggccatctccatttctgtgaccaagaaagcggcttcctgggaaggcattgctcagggccatgtcatgatcactgtggcttccccagcagagacagagtcaaaaaatggtgcagaacagacttcaacagtaagctccccattaaggtgaagataattcctactcccccgcgaagcaagagagttctctgggatcagtaccacaacctccgctatccacctggctatttccccagggataatttaaggatgaagaatgaccctttagactggaatggtgatcacatccacaccaatttcagggatatgtaccagcatctgagaagcatgggctactttgtagaggtcctcggggcccccttcacgtgttttgatgccagtcagtatggcactttgctgatggtggacagtgaggaggagtacttccctgaagagatcgccaagctccggagggacgtggacaacggcctctcgctcgtcatcttcagtgactggtacaacacttctgttatgagaaaagtgaagttttatgatgaaaacacaaggcagtggtggatgccggataccggaggagctaacatcccagctctgaatgagctgctgtctgtgtggaacatggggttcagcgatggcctgtatgaaggggagttcaccctggccaaccatgacatgtattatgcgtcagggtgcagcatcgcgaagtttccagaagatggcgtcgtgataacacagactttcaaggaccaaggattggaggttttaaagcaggaaacagcagttgttgaaaacgtccccattttgggactttatcagattccagctgagggtggaggccggattgtactgtatggggactccaattgcttggatgacagtcaccgacagaaggactgcttttggcttctggatgccctcctccagtacacatcgtatggggtgacaccgcctagcctcagtcactctgggaaccgccagcgccctcccagtggagcaggctcagtcactccagagaggatggaaggaaaccatcttcatcggtactccaaggttctggaggcccatttgggagacccaaaacctcggcctctaccagcctgtccacgcttgtcttgggccaagccacagcctttaaacgagacggcgcccagtaacctttggaaacatcagaagctactctccattgacctggacaaggtggtgttacccaactttcgatcgaatcgccctcaagtgaggcccttgtcccctggagagagcggcgcctgggacattcctggagggatcatgcctggccgctacaaccaggaggtgggccagaccattcctgtctttgccttcctgggagccatggtggtcctggccttctttgtggtacaaatcaacaaggccaagagcaggccgaagcggaggaagcccagggtgaagcgcccgcagctcatgcagcaggttcacccgccaaagaccccttcggtgtgaccggcagcctggctgaccgtgagggccagagagagccttcacggacggcgctggtgggtgagccgagctgtggtggcggctggtttaaaagggatccagtttccagctgcaggtttgttagagtctgttctacatgggcctgccctcctgtgatgggcagaggctcctggtacatcgagaagattcctgtggatcccgtcaggagggacttagtggctctgccgccagtgagacttcccgccggcagctgtgcgcaccaaagactcgggagaactggaaaggctgtctggggtcttctgactgcaggggaaggatgtactttccaaacaaatgatacaaccctgaccaagctaaaagacgcttgttaaaggctattttctatatttattgttgggaaaagtcactttaaagacttgtgctatttggaagcaaagctattttttttgtcagtggaatgcagtttttttactattccatcatgaggaacaacatagattccatgatctttttaatgacagtacagactgagatttgaaggaaacatgcacaaatctgtaaaacatagaccttcgctttatttttgtaagtatcacctgccaccatgttttgtaatttgaggtcttgatttcaccattgtcggtgaagaaaattttcaataaatatgtattacccgtctgaagctt

SEQ ID NO: 17764 - DNA, 4457 bp, Homo sapiens
aaggcgcgcgcggtcagctgttggcggtgcagggaggaggacgccggggctcgccttccctcctctgccgccgctgccgccatgattccggtgtcgctggtggtggtggtggtgggtggctggactgtcgtctacctgaccgacttggtgctgaagtcatctgtctattttaaacattcttatgaagactggctggaaaacaacggactgagcatctcccctttccacataagatggcaaactgctgttttcaatcgtgccttttacagttggggacggcggaaagcaaggatgctttaccaatggttcaattttggaatggtgtttggcgtaattgccatgtttagctcattttttctccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtggttcctggtataaatttacccgtcaatcaactgacctatttcttcacggcagttctcattagtggtgttgtacatgaaattggacatgggatagcagctattagggaacaagttcgatttaatggctttgggatttttctcttcattatttatcctggagcatttgttgatctgttcaccactcatttgcaacttatatcgccagtccagcagctaaggatattttgtgcaggtatctggcataattttgtccttgcactcttgggtattttagctcttgttctcctcccagtaattctcttgccattttactacactggagttggggtgctcatcactgaagttgctgaggactctcctgccattggacccagaggcctttttgtgggagaccttgtcacccatctacaggattgtcctgttactaatgtgcaagattggaatgaatgtttagataccatcgcctatgagccccaaattggttactgtataagtgcatcaactttacagcagttaagtttcccagttagaggtgtgtatatttcctcaatataatataatgcttcaagcaccagtacctgccattcactaatccttaaaccatgtctatacatttattctgttctaatctgtttaaagcaaatcagtaaagtaaatagattccaaccaatagacatttttcttggtaagttggatgctaatatgtgtttcctttattatatattgttgaacttctaactattttcattatatcatatttaacttttaggactctaatattttctgctttcaaaacacttgtattaaatcatagccgggcgcagtggctcacgcctgtaatcccagcactttgggaggctgaggcgggcggatcacttgaggtcaggagttcatgaccaacctggccaacatagtgaaaccccatctctactaaaaatacaaaaattagcagggcatggtgacgggtgcctgtgatttcagctgctcgggagtctgaggcaggagaatcgcttgaacccgggaggtggaggttgcaatgagccgagatcgggacatggaaagagactctgtctcaaaaaaaaaaaaaaaaatcagcattcaaggtcaatcataaccaattaactaattccaataatcaaataccccaatataatattatctttatgcatgtctgtagatatattatagtactttaaacttttataattgaaaaagggaatataagtaataagaaccggttctactttgcataagcttatgtcagaacagataaacaacgatagttaacaactaaatatataaaaatcaaagcataaacattctgtattaatatattgttagcccaacacagacatgcaataaggaaagattacaagaaataagaaggaacttggcaaacaaaaaaccccatctgggatttagaaaaaattcccttacttcttaaaaattcccttaatacttaaacagttctagtggaatcagtgttggcatgtctgattctatctggggtagagttattttatgtattttatgtggcagccatcctaaagaagttgtcttggcttccaaaaataccatgtgaagtcagatatgttgctctgtgcagcagatgacagagctgaggcaagtttcttctcggatcctgccaaacttatttagagttatttcagctctgaaaaatcagcttcccaattctttatacaaaatcagcttcccaattctttatacaaaattggaggtgttagaaaatagaaattatgctcacagactatatctttaagtaaaaaaatatcctgatacttgtccacatctattggtgtagggaaatatgattaataatcaagaatagttttagtaaagtactgtgtgcaacacaggcaaagtagtaagaactgatttttttaaaaaaactttttaaaatttactcatttgtaagaatttttttattatcaaaaatgtttagacacgatggagaatatatttcctcaatataatataatgcttcaagcaccagtacctgccattcactaatccttagaccatgtctatagatttattctgttctaatctgtttaaagtaaatcagtaaagtaaatagattcaaaccaatagacatttttcttggtaagttggatgctaatatgtgtgtttcctttattatatattgttgaacttctaactattttcataatatcatatttaacttttaggactctaatattttctagtataaacgagcccacatgtatctttctgccagcttcggcagttattaacattttgccaattttttcatctaagcagtccacttttaggggaagtattttaaagtacatcccaggcatcctatcatttcatccataacctttcagcctgcctttaacggatgatgactcattaaacacgaccacaatactgttataattcctaacaaaataacactaatttctgatatctggttggtattcagttgtttctaattcttttcattatagttgatttaaattagttaggatgtcttctaagactttttaaatttgtaacaattttccttgacctgtttttgaaatgttatttttttgttgaagaaactgaggcatttgttttgttgaatttcctaaattctgggtttttctggttatatcttatcctcatgatgtcattaacttgttcagatgtcttccaattttctataaactgctaattaggtccatggcgttgattagattcagaatcctttttttttgtttgggttttttttttggcaaaaacacttcataaacagcgcttggtacttcctgtggcatcatattgcatccagtatctattgttctctgttttaatggtgttaagattgttcagtggagcaatctgattctttaaggttgaaatatttataaattttccccattctcaggagcctcttaccatcttccaaaacttttaagatgacagaagattaatatgtaatccacaatgtgttcttctttaaagaaatgatccattattttccacttcttaagtcctttatccttttcttttggtttctctaaatttgatgtaatgtgtattgaattacaaaaaccaaagtgacacactagttaaataaagttctcttcagtaggattgttttacttaggatatctgcattttcagatgtttagggttttatccttttcctgacagacagactgtaaataaaaattttccctgaaacactcagaaactctcttcttattaactgtttgagtatttcactgttgtggatcatgtgctacattttggaggtatttgtttaaatacctaaagcagatattactctttttatactacaatcaatccagaagtaattcttttttttttttttcaagccctgggctgtcccagcccaagagtaattcttcaatatctattttgtctcagtatacatgtttattttacatgattactatatctgataaatctgtgcctctatttaagcttttgaaaatggagtatgtatacttagccagtttaaaggagtattaatgtctgtaaatatcacttaaaatacatactatggctggtccaaatgcagttgtgcttacaattaattgaacacaaccagttacagaattctttgttccttctctattcccactacatcacttgactagccttaaaaaaaaaatacatactagattaattttgatggcaggcttagcccctgggtctgtggacatttaagaaagctatggattgatggtattttatatgtttctaggtaacttcgttatccttcattgtaagtaggagtgaaagatatggtcagatatactattacagagtgtccaatgatccaaaagttattcatgttcaatttagagtagaattcagtacacataactaaattctaggaatttataccatttcagagcaataaagccacctaggaaaga

SEQ ID NO: 17765 - DNA, 4428 bp, Homo sapiens
agcggatgctggggctgtaaggcgcgcgcggtcagctgttggcggtgcagggaggaggacgccggggctcgccttccctcctctgccgccgctgccgccatgattccggtgtcgctggtggtggtggtggtgggtggctggactgtcgtctacctgaccgacttggtgctgaagtcatctgtctattttaaacattcttatgaagactggctggaaaacaacggactgagcatctcccctttccacataagatggcaaactgctgttttcaatcgtgccttttacagttggggacggcggaaagcaaggatgctttaccaatggttcaattttggaatggtgtttggcgtaattgccatgtttagctcattttttctccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtggttcctggtataaatttacccgtcaatcaactgacctatttcttcacggcagttctcattagtggtgttgtacatgaaattggacatgggatagcagctattagggaacaagttcgatttaatggctttgggatttttctcttcattatttatcctggagcatttgttgatctgttcaccactcatttgcaacttatatcgccagtccagcagctaaggatattttgtgcaggtatctggcataattttgtccttgcactcttgggtattttagctcttgttctcctcccagtaattctcttgccattttactacactggagttggggtgctcatcactgaagttgctgaggactctcctgccattggacccagaggcctttttgtgggagaccttgtcacccatctacaggattgtcctgttactaatgtgcaagattggaatgaatgtttagataccatcgcctatgagccccaaattggttactgtataagtgcatcaactttacagcagttaagtttcccagttagagcatacaaacgactagatggttcaactgaatgctgtaacaatcacagcctcacagatgtgtgcttttcctacagaaataattttaataagcgtttgcatacatgtcttcctgcccggaaagcagttgaagcaactcaagtttgcagaaccaataaagactgtaaaaaaagctcaagttcaagtttctgtataataccttctttggaaactcacactcgcttaataaaagtaaaacacccacctcagattgatatgttatacgtaggacatcctctgcatcttcactacacagtgagcatcaccagttttatcccacgttttaactttctaagcatagatctgccagtggttgtggagacatttgtcaagtacctgatttccctctcaggagctctggctattgttaatgcagtaccctgctttgctttggatggacaatggattctaaactctttcttggatgccacccttacctcagtgattggagacaatgatgtcaaagatctaatagggtttttcatcttgctgggtggcagtgtacttttggctgccaatgtgaccctgggactctggatggttacagcacggtaatgtttgcactcatctgacagaatccctgagttacagtatacagctatgtggtaatattcattgccattgaaattcttacttggtatgaaatataaagtgtttccttaaaattacatcttagccaacaaccctgagctcctcccatatccagagtacccaaactctgtggtagaagataagcagaagaaatgaaaggcatagtccctgactatattctaatttaggactgaatgtacccagatgcttgtggaataatatctaagcaagtgcaaattcatgtaataccgttttgtctgattacatattgtgttgaaatagtataaaggagaacagaactgggtggaattaattgggaaaaacttcttacaaaagcatcattaatcaaaatttgaaggagaccagactttggccaagtggaaggatgaccattgtcttggcctgtatctcttgtcctttgtcttgtttgaaaagtattttaaaacttaatggtgtattattttgtgctctgaaagctgaggtctgattacaattagtaaaattctatagaagaatctgctgacgtgaaagggaaaaatctttgtcaaatgataccaaataaatgaacaaaacaggaagtagggcctatgatatcgtgagacatgttttgccccacaagagttgcatcttttataaggtgtctctgccccctcataaagcagcactagctttgacatccacggtgagctgcaggaagcatcacacaccagcagcatgtgagcagagggaggcagttggggttgaacttcggaactaggccgggtctcctgacagatcacaagacaccccagaggatcttcagcagtcctacttcccattctctatagagctttgaagcttggaacccttccagggtaaacattttctcttgtgctgctcaggacatctggggcctagctcctgggttcctgtctccaagaagcaatgaccttaaactctgagccatactctgtcctcaccagcggctcccatgtttttctgtgtcaggttattaagtacctagtccttgttttctgtctctctcctaagctacctctctgggtccacagaagacttggtagtatagtgagaatggctatacgtgagtacaaacgtggattttccagggcttgggaactgattcttgagcccagaagagccacgcctgctttgaggtcttttggagtggagatgcagccctgggaaatttggggagtcagcaggccagtgtgaagctattggtcctaggagtatatgagcttgctgtttctttgatggaaaatacatgcttctcttgtatactcagaagtgactaagggcaataactcattaatagccatctatccaacttctttactgagtgatgtattccatggggttacctttttcagattattgagttgctctgtaagcactaaaactttttaatcatttttaagaaactttttagattgtattacaaatttgccttaacagtaattagatgttgaatataattttaacattttattaatgacttgggtcatcagttaataccagtactaaaaccatacgaattattggtttattccagaaaatacagtatttgttctatttttaggtagacaatcatttgggatcagagtacattagcatagtaatgctcagtcagacctgttcaagtagtagagcttggagaatgccatgaaatacttatataattaatttgattgcatgaactaagcaattttactaatgaaaaggttgtatatgtgcaagtcacttttttaaaaaccaagaaaaaactttaatagaggaaatcttattcattaatttatttttctgagtaaaaaaacgaaacccaaatctcattttatttcaactgttaaacattttgatctgttgacccataggatcaggatttgggaaccactttactaggaaagagcagatcagtaccatttgtataaaaccggcctcattatgtaagaaagaaaatgttacgtgttttcttctttagcttggttgtgggcacttctacagcaaggaccatatcatattcatctttgcatccctggcacagtgcatgagacataagtacttaataaatgcagttgaatggataatgattagtgttatttatggattagaaaaagcatgtttctatttaagtaagctgtaaaaagtattattgaatatttactgtaaatatatgttcacataaaaaaataacttggagggtctttgtgtccctggcatattatcatcttcatggaaagaatccactgtggtttctgtagagtgattggaaaaatggattattttgaggattgaagaaagtgttctttctgcgttgtcactttgttcaacagtaaaactttattctcagtgttcctactctgcattgtttacatttttgacagttttttttaatcacctacaatctgtaaagaatgtatatattcttttcagcatctcagtttgaaaagacatgcagttaaacttgaccttttgataatcgctcttacaggtcattgtctgttctaacagcaaattgtaaacatgtgcttcatagatattgtggctctcagtcatcactttgtcctatggtatttattgaatgttcacatactaatggtgcacaggtgtttttttctataaatcttctgactgtcctgtaattcattcttaagctttaacttgaaggtatcgtaattgccggcatttgatgtttagcaataaaagaataaatgtgtaccagcattttatgtttat

SEQ ID NO: 17766 - DNA, 1676 bp, Homo sapiens
gaacttgcccagagccctgcatgcatcagacctacagcagacattgcaggcctgaagaaaggtggtcacaagaggggtggaacattcctgcaaatggtttcaatatatgcagatgtctcaatataggaatgaaattacgtctttggaacaacttaaataagtcaaatatacttggagctttaaaaattaaaaggagagagattcgagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatgggtctggatggcatggtgctcctcctaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaccaaaagatcaacagacaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctcatttttttccctggaactcaataactcatttcactggctctttatcgagagtactagaagttaaattaataaataatgcatttaatgaggcaacagcacttgaaagtttttcattcatcataagaactttatataaaggcattacattggcaaataaggtttggaagcagaagagcaaaaaaaagatattgttaaaatgaggcctccatgcaaaacacatacttccctcccatttatttaactttttttttctcctacctatggggaccaaagtgctttttccttcaggaagtggagatgcatggccatctccccctccctttttccttctcctgcttttctttccccatagaaagtaccttgaagtagcacagcccgtccttgcatgtgcacgagctatcatttgagtaaaagtatacatggagtaaaaatcatattaagcatcagattcaacttatattttctatttcatcttcttcctttcccttctcccaccttctactgggcataattatatcttaatcatatatggaaatgtgcaacatatggtatttgttaaatacgtttgtttttattgcagagcaaaaataaatcaaattagaagc

SEQ ID NO: 17767 - DNA, 1284 bp, Homo sapiens
tattagttggctcttttcatggttttactgaagttgctagaagtttacagaaaaggaagtgcaggaacatttcacaaatctacaatctttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaatcagtcagtcatgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatcaaa

SEQ ID NO: 17768 - DNA, 2296 bp, Homo sapiens
tctctggggagctccggcagcgcaagagggcaaagcacagctggaagctcagagctgcagtcccaggtcctgggccagggcccccatccagcatcaatgaaagcagaagccacagttattcccagccgttgtgctagggggctcccatcatggcaagtcctcagcccagtccagccctggcagacaagtgcaccccagaacacgacccagcccaagctcctggctccacaccagcacgagaagtcccagaagaagagcagccttcttaaggagctgggggccttccacatcaccatcgctctgctgcacctggtctttgggggctacctggcctctatagtcaagaaccttcacctggtggtgctgaagtcttggtatccattctggggggctgcctcttttctcatttcagggatcttggcgataacaatgaagaccttttctaaaacttacctgaagatgttgtgcctgatgacaaacctcatcagcctcttttgcgtgctgtctggcctcttcgtcatctccaaggatctctttctggagagcccatttgagtccccgatctggagaatgtaccccaactccacggtccacatccagaggctggagctggccttgctctgcttcactgtcctagagctcttcctgccagtgcccacagctgtcacagcctggagaggggactgcccatctgcaaagaatgatgatgcatgccttgttccgaatacaccattgcatctcaaaggcctgccggtggagcccccgccatcctaccagagtgtgattcaaggcgacgcacaacacaagcaacatcagaggctcagagaagttaagcaagttgccccggacacatggatagtcactgacggagctgcgatctggacccagactgcaaactgaagagccactgcctgacaatgcccaaacttggttggagcatagcccctgctctcccaaagttgcactttcactgggaagatgagatttgcacatacaaaaggctagagcgatggtctatacagcaaagtcagccctcacagctcctgggaacgctgtcctctcagataagccatttcttacatagttgatggctcgatatctgtggtggcccagattgttttgttttgtttcgctttgttttgttttcttttgttttgttgagatggagtctcgctctgttgcccagcccagagtacagtggcactatctcagctcactgcaatctccgcctccctggttcaagtgattctcctatctcagcctcccaagtagctgggactataggcacacgccaccacgcccagctaatttttatatttttagtagagacaggattgcaccatattggtcagcctggtctcaaactcctgacctcaggtgatccacctgcctcagcctcccaaagtgctgggattacaggcgtgagccactgtgcccagcccaggttttgaagttgtccgagatagcagtctgctctctactgccttataaaatccctgtgtgaagggatgctctcagtatcatttgcccttgcacagaatatccctggggtttgaggttctttgaattctccctctttgtcatctctttcgctgccacttctggctgtggtcactagcttggccatagcacctctcttctccacttctgatctgctgcttctaaccttctatagattgcagctggctttaaaatagattgtaaagtgtaaggcattaggttctgagacagcggcagagagagccatgcaaatgtttaggacaacccagtctttctttttttttttttttttttttttttttgagacggagtctcactctgtcacccaggctggagtgctgtggtgcaatctcggctcactgcaacctctgcctcccgagttcaagcaattctcctgcctcagcctcccgagtagctgggattacaggcgaccgccaccacgcctggctactttttgtatttttagtagagacagggtttcaccacgttagccatgatggtctcaaacttctgacctcataatccacccaccttggcctcccaaagtgctaggattacaggcatgagccaccacccctggctgaaacccaatctttcaaaacatgaaagggggtgatggagaaaaccttagcttggttgtctaaagacatgggtgcaaactctaggctagctctgccaatcacttactgtgcgggtttgactcagtcccttcccctcactaggtcccagtttctccatttgtaaaacaagcaattgtgctacattgatggtttacatcaataaaggttgaaacggc

SEQ ID NO: 17769 - DNA, 1167 bp, Homo sapiens
acacaggttggagcagagaaagaggaaacatagaggtgccaaaggaacaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctacggcatcacatctccgggaatctttgctagcagtcaaccgggtcaaggaaatatacaaatgataaatccaagtgtgggaacagcagtaatgaactttaaagaagaagcaaaggcactaggggtgatccagatcatggttggattgatgcacattggttttggaattgttttgtgtttaatatccttctcttttagagaagtattaggttttgcctctactgctgttattggtggatacccattctggggtggcctttcttttattatctctggctctctctctgtgtcagcatccaaggagctttcccgttgtctggtgaaaggcagcctgggaatgaacattgttagttctatcttggccttcattggagtgattctgctgctggtggatatgtgcatcaatggggtagctggccaagactactgggccgtgctttctggaaaaggcatttcagccacgctgatgatcttctccctcttggagttcttcgtagcttgtgccacagcccattttgccaaccaagcaaacaccacaaccaatatgtctgtcctggttattccaaatatgtatgaaagcaaccctgtgacaccagcgtcttcttcagctcctcccagatgcaacaactactcagctaatgcccctaaatagtaaaagaaaaaggggtatcagtctaatctcatggagaaaaactacttgcaaaaacttcttaagaagatgtcttttattgtctacaatgatttctagtctttaaaaactgtgtttgagatttgtttttaggttggtcgctaatgatggctgtatctcccttcactgtctcttcctacattaccactactacatgctggcaaaggtgaaggatcagaggactgaaaaatgattctgcaactctcttaaagttagaaatgtttctgttcatattactttttccttaataaaatgtcattagaaacaaaa

SEQ ID NO: 17770 - DNA, 582 bp, Homo sapiens
aggaaacatagaggtgccaaaggaacaaagtaagtccattgatacgttcttgcctatctctcctccaaatcaatgggcacaaactgtggctggtctacctgtgtgggttctgttctctagattggagggatgaagacaagttcttgactctatgttgaggccagttgaaaaatgagggagaataaaaccatgaacgaaacaagaaagaaacaaaacagaagaggaatgaaaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctacggcatcacatctccgggaatctttgctagcagtcaaccgggtcaaggaaatatacaaatgataaatccaagtgtgggaacagcagtaatgaactttaaagaagaagcaaaggcactaggggtgatccagatcatggttggattgatgcacattggttttggaattgttttgtgtttaatatccttct

SEQ ID NO: 17771 - DNA, 1019 bp, Homo sapiens
acacaggttggagcagagaaagaggaaacatagaggtgccaaaggaacaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctacggcatcacatctccgggaatctttgctagcagtcaaccgggtcaaggaaatatacaaatgataaatccaagtgtgggaacagcagtaatgaactttaaagaagaagcaaaggcactagggtttattatctctggctctctctctgtgtcagcatccaaggagctttcccgttgtctggtgaaaggcagcctgggaatgaacattgttagttctatcttggccttcattggagtgattctgctgctggtggatatgtgcatcaatggggtagctggccaagactactgggccgtgctttctggaaaaggcatttcagccacgctgatgatcttctccctcttggagttcttcgtagcttgtgccacagcccattttgccaaccaagcaaacaccacaaccaatatgtctgtcctggttattccaaatatgtatgaaagcaaccctgtgacaccagcgtcttcttcagctcctcccagatgcaacaactactcagctaatgcccctaaatagtaaaagaaaaaggggtatcagtctaatctcatggagaaaaactacttgcaaaaacttcttaagaagatgtcttttattgtctacaatgatttctagtctttaaaaactgtgtttgagatttgtttttaggttggtcgctaatgatggctgtatctcccttcactgtctcttcctacattaccactactacatgctggcaaaggtgaaggatcagaggactgaaaaatgattctgcaactctcttaaagttagaaatgtttctgttcatattactttttccttaataaaatgtcatt

SEQ ID NO: 17772 - DNA, 969 bp, Homo sapiens
atgaccgaacaggtgattggagccaacagtgtacctggcattattgccccagataatgttcacgtcatccagcccagcaaccctgtggcctctggaaatcatctgcagccttcagaggtgaccacttacccaatctcaccaaaagtaatccactgtgatacaggaagagcaaacttacagaatctactcgtggtgaaccagaactcagcagcaggtgtacagagtcaacccattgggtatcagcgacagtatccagtgggaacagccagtttgcagacggtgcctggagtgatccaatacacacagggaaccacgaatctccagacatggcctggagaccttcagaatcctctgaatgctaaccctgggctgacacacacctcaaactcatcccagtggaacacgtcatttgcatcatttacttcatttaatcccaagaaattcataaatgaggaggtcagaacattaggggccatccagatcctcatcggcctgacgcacattttctctgcaattaaccctgtgctgtattactatccttttgtgacctggttgtcagggtacccgctctggggaggattatcctatattgtatctggatccctctcagtatgggctgcaaaggaccccagtccttgtgtggtgaacagcagcatcagcttcaacatcatcagcgcactcttcgcctttgccgggatcttcattatcattacagatctgagcctttactatgtgacgacatattcaaaggcggtttctggcggtcttctcccctttgccctcctggagttcatcctcacttgtgtggtctcacattttgggtgccaggctacctgctgcagacaatttgagaatgtggcagtgattccaaccgtattcagtttcaacccagccaataccaccaccagccctgtcaatgctaccactggtcctgtcaatgctgccactggccctgtcagtgccaccaat

SEQ ID NO: 17773 - DNA, 1152 bp, Homo sapiens
aacccatttcaactgcctattcagagcatgcagtaagaggaaatccaccaagtctcaatataataatattctttattcctggacagctcggttaatgaaaaaatggacacagaaagtaataggagagcaaatcttgctctcccacaggagccttccagtgtgcctgcatttgaagtcttggaaatatctccccaggaagtatcttcaggcagactattgaagtcggcctcatccccaccactgcatacatggctgacagttttgaaaaaagagcaggagttcctgggggtaacacaaattctgactgctatgatatgcctttgttttggaacagttgtctgctctgtacttgatatttcacacattgagggagacattttttcatcatttaaagcaggttatccattctggggagccatatttttttctatttctggaatgttgtcaattatatctgaaaggagaaatgcaacatatctggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgaaattgtagtgatgatgctgtttctcaccattctgggacttggtagtgctgtgtcactcacaatctgtggagctggggaagaactcaaaggaaacaaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggtcttgttaaggggctactggaaaaatttctattctctccacagcctgctggttttacattagatttattcgcctgataagaatattttgtttctgctgcttctgtccaccttaatattctccttctatttgtagatatgatagactcctatttttcttgttttatattatgaccacacacatctctgctggaaagtcaacatgtagtaagcaagatttaactgtttgattataactgtgcaaatacagaaaaaaagaaggc

SEQ ID NO: 17774 - DNA, 541 bp, Homo sapiens
ttcagttttgggtctatgtgtgaaaccaagcatgccttaaacaaggaagacaagcttttcaaaggtgcaattggataacttctgccatagaaatggctgaattgggacacaagtggggacaattccagaagaagggcacatctctttcttttctgcagttctttctcaccttctcaactcctactaaaatgtctcattttcaggttctgtaaatcctgctagtctcaggcaaaattatgctccaggagtctcaaattttcttatttcatattagtctttatttagtagacttcttaatttttctattcatcacaagtaaaagcctgttgatcttaatcagccaagaaacttatctgtctggcaaatgacttatgtataaagagaatcatcaatgtcatgagctcggttaatgaaaaaatggacacagaaagtaataggagagcaaatcttgctctcccacaggagccttccagtgtgcctgcatttgaagtcttggaaatatctccccaggaagtatcttcaggcagactattgaagtcgg

SEQ ID NO: 17775 - DNA, 1613 bp, Homo sapiens
acttgcgacaaggtggacttgggaggaaagccgtctgccaaagcctgaagcctccaagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttggggccatccagatcctgaatgcagcaatgattctggctttgggtgtctttctgggttccttgcaatacccataccacttccaaaagcacttctttttcttcaccttctacacaggctacccgatttggggtgctgtgtttttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 17776 - DNA, 1516 bp, Homo sapiens
ggaggcttccgttatcgggaaaagatgctgtagtgatcttttctgagtgtctcctacttgcgacaaggtggacttgggaggaaagccgtctgccaaagcctgaagcctccaagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttgggttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagc

SEQ ID NO: 17777 - DNA, 867 bp, Homo sapiens
ctctaaagtgttgcataaggcaaagataacgttaagtctgtggaggcttccgttatcgggaaaagatgctgtagtgatcttttctgagtgtctcctacttgcgacaaggtggacttgggaggaaagccgtctgccaaagcctgaagcctccaagttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatcccta

SEQ ID NO: 17778 - DNA, 507 bp, Homo sapiens
atggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttgggttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaa

SEQ ID NO: 17779 - DNA, 1604 bp, Homo sapiens
aatgcagatttaaactgagtgaggtgtggagtgggggaagttgattgggtctagaccaaagaactttgaggaacttgcccagagccctgcatgcatcagacctacagcagacattgcaggcctgaagaaagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatgggtctggatggcatggtgctcctcctaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaccaaaagatcaacagacaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctcatttttttccctggaactcaataactcatttcactggctctttatcgagagtactagaagttaaattaataaataatgcatttaatgaggcaacagcacttgaaagtttttcattcatcataagaactttatataaaggcattacattggcaaataaggtttggaagcagaagagcaaaaaaaagatattgttaaaatgaggcctccatgcaaaacacatacttccctcccatttatttaactttttttttctcctacctatggggaccaaagtgctttttccttcaggaagtggagatgcatggccatctccccctccctttttccttctcctgcttttctttccccatagaaagtaccttgaagtagcacagcccgtccttgcatgtgcacgagctatcatttgagtaaaagtatacatggagtaaaaatcatattaagcatcagattcaacttatattttctatttcatcttcttcctttcccttctcccaccttctactgggcataattatatcttaatcatatatggaaatgtgcaacatatggtatttgttaaatacgtttgtttttattgcagagcaaaaataaatcaaattagaagcaata

SEQ ID NO: 17780 - DNA, 1676 bp, Homo sapiens; identical to SEQ ID NO: 17766

SEQ ID NO: 17781 - DNA, 1596 bp, Homo sapiens
aacattcctgcaaatggtttcaatatatgcagatgtctcaatataggaatgaaattacgtctttggaacaacttaaataagtcaaatatacttggagctttaaaaattaaaaggagagagattcgagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatgggtctggatggcatggtgctcctcctaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaccaaaagatcaacagacaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctcatttttttccctggaactcaataactcatttcactggctctttatcgagagtactagaagttaaattaataaataatgcatttaatgaggcaacagcacttgaaagtttttcattcatcataagaactttatataaaggcattacattggcaaataaggtttggaagcagaagagcaaaaaaaagatattgttaaaatgaggcctccatgcaaaacacatacttccctcccatttatttaactttttttttctcctacctatggggaccaaagtgctttttccttcaggaagtggagatgcatggccatctccccctccctttttccttctcctgcttttctttccccatagaaagtaccttgaagtagcacagcccgtccttgcatgtgcacgagctatcatttgagtaaaagtatacatggagtaaaaatcatattaagcatcagattcaacttatattttctatttcatcttcttcctttcccttctcccaccttctactgggcataattatatcttaatcatatatggaaatgtgcaacatatggtatttgttaaatacgtttgtttttattgcagagcaaaaataaatcaaattagaagc

SEQ ID NO: 17782 - DNA, 698 bp, Homo sapiens
attctcagcacagcctttaaggttccaaacatctgctagaagaggaatgcagatttaaactgagtgaggtgtggagtgggggaagttgattgggtctagaccaaagaactttgaggaacttgcccagagccctgcatgcatcagacctacagcagacattgcaggcctgaagaaagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctgggtctggatggcatggtgctcctcctaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgagg

SEQ ID NO: 17783 - DNA, 479 bp, Homo sapiens
atgacaaccatgcaaggaatggaacagaccactccaggggctggccctgatgtgccccagctgggaaacatagatgtcatacattcatatctgtgtaaaggattgcaagagaagttcttcaagaggaaacccaaagtccttggggttgtgcggattctgattgccttgatgagccttagcatgggaataataatgatgtgtgttgcatttagttcttatgaagaacatcccatttttgtgtatgttgcgtacacaatttgggggtcagtgatgtatccttatcagttgcagcaggaattagaacaacaaaaggtctggaattatctgaagaatttaagctggagaataatgggatcatatttgtgttttggcgagagatcagagttgaaaccactataaggagacaagttagaagactattgaaataagataaaggttggaggtagtctaggaaagaatatcaccagttcagtcttggc

SEQ ID NO: 17784 - DNA, 384 bp, Homo sapiens
atgacaaccatgcaaggaatggaacagaccactccaggggctggccctgatgtgccccagctgggaaacatagatgtcatacattcatatctgtgtaaaggattgcaagagaagttcttcaagaggaaacccaaagtccttggggttttgtgtggacataagttttcaactcattcggtatccttatcagttgcagcaggaattagaacaacaaaaggtctggaattatctgaagaatttaagctggagaataatgggatcatatttgtgttttggcgagagatcagagttgaaaccactataaggagacaagttagaagactattgaaataagataaaggttggaggtagtctaggaaagaatatcaccagttcagtcttggc

SEQ ID NO: 17785 - DNA, 1125 bp, Homo sapiens
agtgcagatttaaactgagtgaggtgtggagtgggggaagctgactgtgtctggaacaaagaactttgaggaacttgcccagagccctgcactcatcagacctgcagcagacattgcaggcctgaagaaagcaccttttctgctgccatgacaaccatgcaaggaatggaacagaccactccaggggctggccctgatgtgccccagctgggaaacatagatgtcatacattcatatctgtgtaaaggattgcaagagaagttcttcaagaggaaacccaaagtccttggggttttgtgtggacataagttttcaactcattcgggttgtgcggattctgattgccttgatgagccttagcatgggaataataatgatgtgtgttgcatttagttcttatgaagaacatcccatttttgtgtatgttgcgtacacaatttgggggtcagtgatgtatccttatcagttgcagcaggaattagaacaacaaaaggtctgtatttatcgagtgctcaatggtgcccaggctggagtgcagtggcgtgatctcggctccctacaacctccacctcccagccgcctgccttggcctcccaaagtgccgagagtgcagcctctgcccggccgccaccccgtctgggaagtgaggagcgtctctgcctggccgcctatcgtctgggacgtgaggagcccctctgcctggctgcccagtctggaaagtgaggagcgtctctgcccggctgccatcccatctaggaagtggggagcgcctcttcccggccaccatcccatctgggaggtgaggagtgtctccgcccggccgcccatcttctgagatgtggggagcgcctttgccccaccgccctgtctgggatgtgaggagcacctctgcccggccgcgaccccgtctgggaggtgaggagcgtctctgcccagccgccccatctgagaagggaggagaccctccgcctggcaaccgccccgtctgagaagtgaggagcccctccgcccggcagccaccccgtctgggaagtgaggagcgtctccgccaggcagccaccccgtccgggagggaggtgggggtcagcccccgccaggccagctgccccatccgggagggaggtg

SEQ ID NO: 17786 - DNA, 555 bp, Homo sapiens
atgacaaccatgcaaggaatggaacagaccactccaggggctggccctgatgtgccccagctgggaaacatagatgtcatacattcatatctgtgtaaaggattgcaagagaagttcttcaagaggaaacccaaagtccttggggttgtgcggattctgattgccttgatgagccttagcatgggaataataatgatgtgtgttgcatttagttcttatgaagaacatcccatttttgtgtatgttgcgtacacaatttgggggtcagtgatgtatccttatcagttgcagcaggaattagaacaacaaaaggtctggaattatctgaagaatttaagctggagaataatgggatcatatttgtgttttggcgagagatcagagttgaaaccactataaggagacaagttagaagactattgaaataagataaaggtagacagcagtgtaaagtaattaacagagatatatctgaggatgatgttggattgcttaattaattttcatttctttctaggttggaggtagtctaggaaagaatatcaccagttcagt

SEQ ID NO: 17787 - DNA, 722 bp, Homo sapiens
caggcagcctcagcacaagaaaagaacatggtctagactgaagtaccaactaaatcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttagggactatccagatcctgtttggaattatgaccttttcttttggagttatcttccttttcaccttgttaaaaccatatccaaggtttccctttatatttctttcaggatatccattctggggctctgttttgttcattaattctggagccttcctaattgcagtgaaaagaaaaaccacagaaactctgataatattgagccgaataatgaattttcttagtgccctgggagcaatagctggaatcattctcctcacatttggtttcatcctagatcaaaactacatttgtggttattctcaccaaaatagtcagtgtaaggctgttactgtcctgttcttgggaattttgattacattgatgactttcagcattattgaattattcatttctctgcctttctcaattttggggtgccactcagaggattgtgattgtgaacaatgttgttgactagcactgtgagaataaagatgtgttaaaata

SEQ ID NO: 17788 - DNA, 1535 bp, Homo sapiens
ttttactgaagttgctagaagtttacagaaaaggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtcatttaagatatgtgttcattggggatctcttgatttgcctgacattgacttcagcaaaagcacggggctgtaaattaccatttactagattagccaaatagtctgaatttccagaaaacaaggcagaatgatcattcccagaaacatttcccagaaaatgtttcccagaaaactagacagaatgatcattcaatggatcacagtgaagcaaaggacacaactttttattgtaccccttaattgtcaacaggagttaactgatttgttgtggtgctcagacttttttatacaggtgctagtgttttatcctatgtattttaactcattagtgcataaaggcaagccccatataatgaagtctcagggtatatgaaagtagctggcttcaaaataaaatttttgagtgc

SEQ ID NO: 17789 - DNA, 863 bp, Homo sapiens
gagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtc

SEQ ID NO: 17790 - DNA, 1536 bp, Homo sapiens
aaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggtttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaatcagtcagtcatgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatcaaacccctatggacttatggctttatttaactgaattaaaaagccttgatttatccaaaattgtattatagagtgtagaatgaatactagggtgataaattgcaattatttgaagaacctggtgatatgctctacttatcttggattagctaagaattctatgtatacagttggaaaaatggcatatatacatctatcttgaacctgattgaagtctgaagacctaacatattttgtttcttctagagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagttt

SEQ ID NO: 17791 - DNA, 1806 bp, Homo sapiens
ctggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaatcagtcagtcatgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatcaaacccctatggacttatggctttatttaactgaattaaaaagccttgatttatccaaaattgtattatagagtgtagaatgaatactagggtgataaattgcaattatttgaagaacctggtgatatgctctacttatcttggattagctaagaattctatgtatacagttggaaaaatggcatatatacatctatcttgaacctgattgaagtctgaagacctaacatattttgtttcttctagagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtca

SEQ ID NO: 17792 - DNA, 1160 bp, Homo sapiens
gtgttgtctcacataatccttaaaactcagaaatgattttaaattaaatagcacagagaggaaaactgactggagagggagcctttgcttagattagaaaactgaagcttcaagaacagacttgcctaacaacaggaaacttgtatgtctcgaagtggcaattcacacataaggctccatgactcctgaactctcacaaatattagttggctcttttcatggttttactgaagttgctagaagtttacagaaaaggaagtgcaggaacatttcacaaatctacaatctttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaa

SEQ ID NO: 17793 - DNA, 1383 bp, Homo sapiens
attccgaagggttctgtgctaggaaccttacacgtgttgtctcacataatccttaaaactcagaaatgattttaaattaaatagcacagagaggaaaactgactggagagggagcctttgcttagattagaaaactgaagcttcaagaacagacttgcctaacaacaggaaacttgtatgtctcgaagtggcaattcacacataaggctccatgactcctgaactctcacaaatattagttggctcttttcatggttttactgaagttgctagaagtttacagaaaaggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtc

SEQ ID NO: 17794 - DNA, 682 bp, Homo sapiens
gatacattgaagtcagcttccaaagaatgccacccaaggttttgaaggggcacagtgcctctgtcctcacaaaaccagcctgcatatgagtttactgaattcatttaggtcctgctgaatctttcccatttgttccttctctgtttcaatatttcaatgcttccctggaggggcccaacctttctggagggcaaagatctgttgttagagaaaaagagcagccagaggaggaagatgacttgaggattagaaaactgaagcttcaagaacagacttgcctaacaacaggaaacttgtatgtctcgaagtggcaattcacacataaggctccatgactcctgaactctcacaaatattagttggctcttttcatggttttactgaagttgctagaagtttacagaaaaggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaa

SEQ ID NO: 17795 - DNA, 711 bp, Homo sapiens
aacttgggagctctgtacttttaagagctaaatctattttttcttccgtagttggcaacaccattatgacatcacaacctatttccaatgagaccatcataatgctcccatcaaatgtcatcaacttctcccaagcagagaaacccgaacccaccaaccaggggcaggatagcctgaagaaacgtctacaggcaaaagtcaaagttattggggtgcatagcagcctggctggaagcattctgagtgctctgtctgccctggtgggtttcattctcctgtctgtcaacccggctgcattaaatcctgcctcattgcagtgtaagttggacgaaaaggatataccaaccagacttcttctttcttatgattatcattcaccttacaccatggactgccatagagccaaagccagtctggctggaactctgtctctgatgctggtttctactgtgttggagttctgcctagctgtgctcactgctgtgctgcagtggaaacagactgtctgacttccctggttactcatgtcctcaaagacgactcatgatgctggatatgaagaactattgacttcttgggaaaaaacggagaaatattaattggaaagttgatttttatgataatatggaaaacctaaccattataaaaaagcaaacttgagtttcctaaatgtaagcatttaaagtaatgcatatttgttttaaaaaatta

SEQ ID NO: 17796 - DNA, 1869 bp, Homo sapiens
aaaattcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcaataaatgttatcagccagtcttccaaaatggtcataaactttataaactgctttgggtaaactgagcagaaggtgatacacagaagggaaaatgtgcactcatgctagtgtgaatttggtaagttgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaat

SEQ ID NO: 17797 - DNA, 2871 bp, Homo sapiens
attcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcaataaatgttatcagccagtcttccaaaatggtcataaactttataaactgctttgggtaaactgagcagaaggtgatacacagaagggaaaatgtgcactcatgctagtgtgaatttggtaagttgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattc

SEQ ID NO: 17798 - DNA, 657 bp, Homo sapiens
caggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaac

SEQ ID NO: 17799 - DNA, 1378 bp, Homo sapiens
atcataaatactgctctaagaaagggacaggaagtctcagaggctggagagcagagcaccaagatcgttctggcaggaacagccagtgggaggttccagctgagcgctccccagagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcaataaatgttatcagccagtcttccaaaatggtcataaactttataaactgctttgggtaaactgagcagaaggtgatacacagaagggaaaatgtgcactcatgctagtgtgaatttggtaagttgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggct

SEQ ID NO: 17800 - DNA, 1353 bp, Homo sapiens
aaacaggaaataaatacgaatgaaactgagctctaagcagcatgtaacctggcctgcatccaggaaatagaggacttcggatccttctaaccctaccacccaactggccccagtacattcattctctcaggaaaaaaaacaaggtccccacagcaaagaaaaggaataggatcaagagatacgtggctgctggcagagcaagcatgaattcgatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcaggatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgaaccctggaatggcgatttctggcgtgctgctggtcttctgcctcctggagtttggcatcgcatgcgcatcttcccactttggctgccagttggtctgctgtcaatcaagcaatgtgagtgtcatctatccaaacatctatgcagcaaacccagtgatcaccccagaaccggtgacctcaccaccaagttattccagtgagatccaagcaaataagtaaggctacagattctggaagcatctttcactgggaccaaaagaagtcctcctccctttctgggcttccataacccaggtcgttcctgttctgacagctgaggaaacgtctctcccactgtttgtactctcaccttcattcttcaattcagtctaggaaaccatgctgtttctctatcaagaagaagacagagattttaaacagatgttaaccaagagggactccctagggcacatgcatcagcacatatgtgggcatccagcctctggggccttggcacacacacattcgtgtgctctgctgcatgtgagcttgtgggttagaggaacaaatatctagacattcaatcttcactctttcaattgtgcattcatttaataaatagatactgagcattcaa

SEQ ID NO: 17801 - DNA, 4945 bp, Homo sapiens
aggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggagagggagggggaagggcagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaatgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtg

SEQ ID NO: 17802 - DNA, 5146 bp, Homo sapiens
aggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggagagggagggggaagggcagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaatgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtg

SEQ ID NO: 17803 - DNA, 3314 bp, Homo sapiens
aggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggagagggagggggaagggcagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttaggtaggtgcaccaggaataatctcttctcctcaaatatattgtccctttaaaaaaaattatcccacagggagaaaaacatttagggaattggcacatttccaagtctcttcaattcgttgcctaggtttctttcaaaaataggcattattgaagacttgagatgcaagtcttagtaaatacatcaagcacattaatttttctcccttgggctaattcagcataagtatcttaaaagtatgttagaaagtactgactttaacttgctctgactgaatgctttctggatggaaccctgtataccacttttatctgatttggagatgagacactatgaaatgtgactccacaagctttctgctgcttgctgtgtcttgataacattaatgctatgtttaacagaacaattgctgaaatgacctaaagggcctggcaagaggaagccatcctcccagccctgtgcgcatgcgagctttagtgtaaggctattctggtgctattcagtattatttcacgtggctttttctttatccttctaccaagtattggttttaccaggggatagaaattgtaatcccctaaacatctctgctacattaaatggacttttgtatgtctcctttgaacactgattttttttttttaaattgtcaaacttggtaaaaagcaccagcatggccaagtttctctagggacttcatttcattttcaggttttcaatccagctataaggaatatgtaatggacttatatacagcacacagcaggcagcaaggctgactgacatgtcatagttttcatagtagtcacaaatactatgatgggtttcatggtcttggttgtgaaatagatatctgaaacaccgtgagcttagaataaaaagtagtagtgagattttccactttctgcctgtatacctttgagctcttaaatattt

SEQ ID NO: 17804 - DNA, 1082 bp, Homo sapiens
aaatgggattaggggaaaatgattcaaggcagaggggtgagctgagctccttggaatggtgtctttaccgaaccaagcctgggttaggcagatgtaatgagcccacctattacaagaatctccatagaaagtagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctggtagtttccttttcttctatctggtaactattcagttagctgagattgaaagagtgctctgcgctagcaaggtcatgaccatatgtgtgatatcatgggcgtgctaggctgactccatctgttctgtggtcatagattgtgctgcttacttctgccagtggattaaacagtgggccactgggcaaagaagtgctggagctgggctaggcccagggcaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggt

SEQ ID NO: 17805 - DNA, 769 bp, Homo sapiens
gctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaag

SEQ ID NO: 17806 - DNA, 5043 bp, Homo sapiens
ggtctgcagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggagagggagggggaagggcagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaatgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgcttgt

SEQ ID NO: 17807 - DNA, 2892 bp, Homo sapiens
cttgcagcaatggcttggattagatccacttgcattctcttttttaccttgctttttgcccacatagcagctgtaccgattaagtatcttcctgaagaaaatgtacatgatgcagattttggtgaacagaaggatatttcagaaatcaatttagctgcaggcttggacctctttcaaggggacatcctcttgcagaaatccagaaatggcctgagagacccaaacaccaggtggacgttccccattccttacatcttggctgataatttggggctgaatgctaaaggagccattctgtatgcctttgagatgttccgtctcaagtcctgtgtggatttcaagccctatgaaggagagagctcatatatcatatttcaacagtttgatgggtgctggtctgaggttggtgaccaacatgtgggacagaacatttccattggccaaggatgtgcctataaggccatcatagaacacgagatcctgcatgctttgggattttaccacgagcagtcaaggacggaccgggatgattatgtgaacatctggtgggaccaaattctttcaggttaccagcacaactttgacacctatgatgatagcttaatcacagacctcaatacaccctatgattatgagtctttgatgcactaccagcctttctcatttaacaagaatgcaagtgttcccaccatcacagccaagatccctgagtttaactccattatcggacagcgcctggatttcagtgccattgatttagagaggctgaaccgaatgtacaattgcaccacaactcacactcttttggaccactgtacttttgagaaggcaaacatctgtggaatgattcagggcaccagagatgacactgactgggcccatcaggacagtgctcaggctggagaagtggatcacaccttgttgggacaatgcacaggtgccggctacttcatgcagttcagcaccagctcggggtccgcggaagaggcagccctactggagtctcggattctttacccaaagaggaagcagcagtgcctgcaatttttctataaaatgacgggaagtccttcagacagactcgttgtctgggtcaggagggatgacagcacaggcaatgttcgcaagttggtgaaggtgcagacttttcaaggagatgatgaccacaattggaaaattgcccatgtggtgctcaaagaggaacagaagtttcgctaccttttccagggcacaaaaggcgaccctcagaactcaactgggggaatttacctagatgacatcactctgacagaaaccccctgccccacaggggtctggacagtccggaatttctcccaagtccttgagaacaccagcaaaggggacaagcttcagagccctcgattctacaattcggagggatatggttttggggtaactttatacccaaatagcagagaaagctctggttacttgagacttgcttttcatgtgtgcagtggggagaacgatgctatcctggagtggccggtagaaaacagacaggtgataattaccatccttgaccaggagcctgatgtccggaacaggatgtcctcaagcatggtgttcactacctcgaagtcgcacacatctccagcgataaatgacactgtcatctgggacaggccgtccagggtgggaacctatcatacggactgtaattgttttagaagcatcgacttgggctggagtggtttcatttcccaccaaatgctgaaaaggaggagtttcctgaaaaatgatgacctcatcatatttgtggactttgaagatatcacccacctcagccagactgaagttcccactaaaggcaaaagactgagcccccaaggcctcattctccaaggccaggagcagcaggtctccgaagaaggttcgggaaaggccatgttagaggaagccctacctgtcagcctgagccaggggcagcccagccgacagaagcggtcggtggagaacacaggccccctggaggaccataactggccacagtacttcagagacccatgtgacccaaacccttgccaaaatgacggcatctgtgtgaacgtgaaggggatggcgagctgcaggtgcatctctggacatgctttcttctacacgggggagcgctgtcaggccgtgcaggtgcacggcagtgtcctgggcatggtgatcggaggcacggctggcgtgatcttcttgaccttctccatcatcgccatcctttcccaaaggccaaggaagtgacctgcctgctggcattggccagaccacagcagcacctcctccatgcaggccttaactttcccatggtcaatgcagtttttatcagccttgctttggataggacctccaaggactaaggcctccagccccatgtgtgacccttgtcatctctctgccccacataattctgttactttgctatgtgctcctaatgtatctagtgtgtcctgtgacaacactcatcacacttcattgtaaatcacttgttttattgactgtctttcctatagactgtaagctccatgagggcaggcacatgttgttctcattgaccgtgctggccccagtgcctagatgcatggctggcacattgttggcactcaacaatggttgaatgaataaaacaataaatgaatgaataactaagatatagaaactctcatttatattgcagattgaatatatatgatgaaattcttatgttgaatatgttagaatcaaatactcatttttcattagatacagtagtgtcatcactcttttaagatcttgttaaagatttcaaataaaggtacttctgggcagccaggctgcacagcatttgctttcctctgagattctaagagaaggcctttaataaatttaataaatattgagttagca

SEQ ID NO: 17808 - DNA, 2309 bp, Homo sapiens
tcaaccctgaatgtcatagttagctactttcaactggaagctacaacatggatttatggaatctgtcttggtttctgttcttggatgctcttctcgtgatttctggcttggcaactccagaaaactttgatgtagatggcggaatggaccaggacatatttgatatcaatgaaggtttgggactggatctttttgagggtgacatcagacttgatagggcacaaattagaaattccatcattggagaaaagtatagatggcctcataccattccatatgttctagaagatagcttggaaatgaatgctaagggagttatcctcaatgcatttgaacgttatcgccttaaaacatgtattgactttaagccttgggctggagaaacaaactatatatcagtgttcaagggcagtggctgctggtcttcagtaggaaataggcgggttgggaagcaagaactttccatcggggcaaactgtgaccgaatagcaacagttcaacacgagttcctccacgctctgggattctggcatgagcagtcgcgttctgaccgggatgactatgtcaggataatgtgggacagaattctgtcaggcagagagcacaattttaacacctatagtgacgatatatcagattccctgaatgttccctatgattacacttcagtaatgcactacagtaaaactgcattccaaaatggaacagagccgacaattgtcacaagaatctcagactttgaggatgtgatcggccaacgaatggatttcagtgactctgatctcctaaagttgaatcaactgtataactgctcctcttccttgagttttatggactcgtgcagttttgaactggaaaatgtgtgtggcatgatccaaagttcaggagataatgctgactggcaacgggtttcacaggttcccagggggccagagagtgatcactccaacatgggccagtgccaaggttctggtttcttcatgcatttcgatagcagctctgtaaatgtgggggccacagcagtgctggaaagtagaacgctgtaccctaaaagaggatttcagtgcctgcaattttacttatataacagtggcagtgaaagtgatcaactgaacatctatatcagggagtattctgcagacaatgtggatggcaatttaacccttgtggaagaaataaaagaaatacccactgggagctggcaactttatcatgtaacattgaaagtgaccaagaagtttagagtggtgtttgaaggacgcaaaggctctggtgcatcactgggtggtctgtctattgatgacatcaatctttcggaaacacggtgccctcatcatatctggcatataaggaatttcacacagttcattggcagcccaaatggaactctgtatagccctccattttactcttctaaaggttatgcctttcagatttacttaaatctagcccatgtgactaatgcagggatatatttccacttgatctctggagccaatgatgatcaattacagtggccatgtccttggcaacaagccacaatgacacttttggatcaaaatcctgacattcgacagcgtatgtccaatcagcggagtataactacagacccatttatgaccaccgataatggaaactatttctgggacaggccttctaaagtgggaacagtggctttgttctctaatggaactcagtttagaagaggtgggggctatggaaccagtgcctttataacccacgaaaggctgaaaagcagagattttataaaaggagatgatgtttatatcctactgacagtggaagacatatctcacctcaactctacacaaatccagctaacaccagcccctagtgttcaagacctctgctcaaaaaccacctgtaaaaatgacggtgtctgcactgttcgagatggcaaagctgagtgcaggtgccagtcaggggaagactggtggtacatgggagaaaggtgtgaaaagagaggctccacccgagacaccatagtcattgctgtttcatctactgttgctgtgtttgccttgatgctgatcatcacccttgtcagtgtctattgcaccaggaagaaatatcgtgaaaggatgagctcaaatcgaccaaatttgactccgcaaaatcagcatgctttttgaagattaactcgacaatatggccagctaatgaaattaaaaaggattcttcatcatggatttcgcctaagtgatattacagccacctcattcttctaaaagtggatatttttctgtaaatagctggaaatattataaatcactattttggtcaaagtc

SEQ ID NO: 17809 - DNA, 1504 bp, Homo sapiens
gctgcaggttggtggcgggaggaggggacagctgcgggcgcggggagggggcgccgcgccgcgggggccatggcggagccaggaagccgggagtccgagacccgggtcgccaatataaatgcttgatgagtgaatgaatgacttccgtctgggacttggttgcaaataaagccgagctgcatcttagggaggggtggagactttgcccctgtttgtgccttgaagccagcagggccttgccctaggatacctccacccaccctcctgcccagcaagtggaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaatctt

SEQ ID NO: 17810 - DNA, 1437 bp, Homo sapiens
gggcggagcgggcgtacccccacggcccggccagtggaaggcgcgggcagcagcggctccgagtggccgcggcggtgggctgtgccggagtctcctccctttggtccgctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaatcttgt

SEQ ID NO: 17811 - DNA, 2116 bp, Homo sapiens
ctctggtatgcaggaaagatagagaggagagggagggaggtgcgaagtcactgttgctgctgctagaagggccagagagagcccaggctggacaggcaaaacctggcctcgccagactcctggagcctgcacagagtgtgtgtctgagaagtccggattctggtgccagactgactgcctagtgagaagcctggcaccgccgggtcaggctagtgcactttttcttgtttgttttttgtttttgagacagagttttgctcttgttccccaggctggattgcaatggcacgatctcggctcactgcaacctccgcctcctgggttcaagcagttctcctgcctcagcctcccgagtagctgggattacaggtgccctccactaagcccggctaattttttgtatttttggtagagacggggtttcaccatgttggccagactggtttcaaacttctgacctcaggtgatccacctgcctgggcctcccaaagtgctgggattacaagcgtgagccaccgcaccaggccaggttagtgcacttctgtgagcctgagtgtcctccttgaaacggtgacaataatataccaggcctcttaagatcactcattcaacacatactggagagtctactgtgtcaggcattgttctaggatattgttaggattcagtggtacccagcaaggactcagtaaattccagctactgttcctattaggtcgccaatataaatgcttgatgagtgaatgaatgacttccgtctgggacttggttgcaaataaagccgagctgcatcttagggaggggtggagactttgcccctgtttgtgccttgaagccagcagggccttgccctaggatacctccacccaccctcctgcccagcaagtggaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaatcttgt

SEQ ID NO: 17812 - DNA, 1345 bp, Homo sapiens
gcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaat

SEQ ID NO: 17813 - DNA, 1453 bp, Homo sapiens
ggaaggcgcgggcagcagcggctccgagtggccgcggcggtgggctgtgccggagtctcctccctttggtccgctgcaggtcgccaatataaatgcttgatgagtgaatgaatgacttccgtctgggacttggttgcaaataaagccgagctgcatcttagggaggggtggagactttgcccctgtttgtgccttgaagccagcagggccttgccctaggatacctccacccaccctcctgcccagcaagtggaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaa

SEQ ID NO: 17814 - DNA, 1331 bp, Homo sapiens
gctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaatcttgta

SEQ ID NO: 17815 - DNA, 738 bp, Homo sapiens
atggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccctgctgtaggcattgaacctggccacatcccaggtaccgtgaacatccccttcacagacttcctgagccaggatggctcctgggtggagtggtacatgcgcgcccggcccgaggatgtcatctcagagggccgggggaagacccactga

SEQ ID NO: 17816 - DNA, 2707 bp, Homo sapiens
gatttaaaagtgtgtcccagcagccctggtccagccctctgcaggcatttgctctgggctccaggacgaactcctcgtcagctggtgcgtctgggttgggacagtgaaaatgtttagtgtcattggcgacaaatacacatacaggggatcccagtaggtaggctggtgcattggaggggcaggagcaagcccgacataggtgtgtgcacacacataggagtagctggccacatgtgtgtgtactttaaggagagactttagttttgggtttttttttttttttggttcctggggtaaattttctgttgaacatttttccctcctatttagttttttttcttttgcatttttaaaaatttgaacataaaaagtataaagaatcaaatctttgaaaggaccgaggcgtgcagcggacagcagatggatcccgcggccagcagctgcatgaggagcctccagcccccagcccctgtctggggctgccttcgaaacccccactcggaaggcaatggggcctcagggctaccccactacccgcccaccccgttctccttccaccagaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcagacaaccaggagaacagagggaagccggagggcagcagcaaagcccgcaaggagaggacggccttcaccaaggagcagctgcgagagctggaggcagagtttgcccatcataactacctgactcggctccgcagatatgagattgcggtaaacctggacctctctgagcgccaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaaccccaagaaaaatcagaatgaggagagtcaaggacagcaactcagctgctgcaagccagaaacacatccctgtctccaaatttgttggctaagtggagacacttctgagaactgactagagaagacagaaaaatagcccgatgtaggtttcggtgtccccatataggcccgtccacacaggcttgactgggtggacaagaatgaacccatgacagcacctgctgcttcaaaatcaaaatcaatttagggatacagcaggggctgttgggctgtgctccagagaaaaggagcagctactccttttaaatccacgatttctggattgaaaacctgtccagatgctgagttgttgggctgaacaactaggagctgaaaacaacgtagaggctggaaagtgtcccctgcattctggaggggaggggagataataaggagggctgctgggtgagggcctggagatgtggaaccctggagtggaaggttctccagtgacagtgtcctgtgactgcaaaaggggacaagaaaatccctcttcctccatgggatggatttaagctcttgctgtgtgttctacaaatgctgttattgtgggaggaaatgctaggtttttgtgtgtggactgcccagacctcagccaggtcttctggagatgacatttgaggactgatggccaaagagcatgggggactgaagccctggctgcctcagcgctctgtctcccaacaccagctggtgttgcagagggaggtcaacgtgagtttggatctcttgtacgcagatgtaatcattcacatgtaaaaataaccccacctccccaccccaaaaagggcaagagctgtggaaaatgattgccaaatgagatggctggttagagcatgattttttctaaagcatacttcatatattttcttaagattacatcaagctaattgtgcgagctcaattcactttgtaagaaaactctcggagaaataaaatcaataaaaagcaaag

SEQ ID NO: 17817 - DNA, 2129 bp, Homo sapiens
aaaggaccgaggcgtgcagcggacagcagatggatcccgcggccagcagctgcatgaggagcctccagcccccagcccctgtctggggctgccttcgaaacccccactcggaaggcaatggggcctcagggctaccccactacccgcccaccccgttctccttccaccagaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaaccccaagaaaaatcagaatgaggagagtcaaggacagcaactcagctgctgcaagccagaaacacatccctgtctccaaatttgttggctaagtggagacacttctgagaactgactagagaagacagaaaaatagcccgatgtaggtttcggtgtccccatataggcccgtccacacaggcttgactgggtggacaagaatgaacccatgacagcacctgctgcttcaaaatcaaaatcaatttagggatacagcaggggctgttgggctgtgctccagagaaaaggagcagctactccttttaaatccacgatttctggattgaaaacctgtccagatgctgagttgttgggctgaacaactaggagctgaaaacaacgtagaggctggaaagtgtcccctgcattctggaggggaggggagataataaggagggctgctgggtgagggcctggagatgtggaaccctggagtggaaggttctccagtgacagtgtcctgtgactgcaaaaggggacaagaaaatccctcttcctccatgggatggatttaagctcttgctgtgtgttctacaaatgctgttattgtgggaggaaatgctaggtttttgtgtgtggactgcccagacctcagccaggtcttctggagatgacatttgaggactgatggccaaagagcatgggggactgaagccctggctgcctcagcgctctgtctcccaacaccagctggtgttgcagagggaggtcaacgtgagtttggatctcttgtacgcagatgtaatcattcacatgtaaaaataaccccacctccccaccccaaaaagggcaagagctgtggaaaatgattgccaaatgagatggctggttagagcatgattttttctaaagcatacttcatatattttcttaagattacatcaagctaattgtgcgagctcaattcactttgtaagaaaactctcggagaaataaaatc

SEQ ID NO: 17818 - DNA, 1206 bp, Homo sapiens
agccctctgcaggcatttgctctgggctccaggacgaactcctcgtcagctgaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcagacaaccaggagaacagagggaagccggagggcagcagcaaagcccgcaaggagaggacggccttcaccaaggagcagctgcgagagctggaggcagagtttgcccatcataactacctgactcggctccgcagatatgagattgcggtaaacctggacctctctgagcgccaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaac

SEQ ID NO: 17819 - DNA, 2500 bp, Homo sapiens
ctgggagcgcgtggcgcaggctgagcgggagttttggagggagtttgcatgtggtcaactctgggctcctaagccagcccccagctcacgttacactctatttataacttctcagagccatttccccctgaaagcagttctctgggaccaccttcttttggcttcaacctctcccactcttgacatctgagtagctcagggaagctcttccaggtccgactgttcatatgtaaaggagactggccgctggggctcaggaccgggattatccgagctctgcagaagtgcaccgctattgctttgggaggttaaaaaaaaaatcacacggtttccagtgaaaaagtgacagagggtggtggcctttggaaccgccgtgaagtcttctgcctggaacccgaaacttgcatgctatggaacacccgctctttggctgcctgcgcagccctcacgccacggcgcaaggcttgcacccgttctcccaatcctctctcgccctccatggaagatctgaccatatgtcttaccccgagctctctacttcttcctcatcttgcataatcgcgggataccccaacgaagagggcatgtttgccagccagcatcacagggggcaccaccaccaccaccaccaccaccaccatcaccaccatcagcagcagcagcaccaggctctgcaaaccaactggcacctcccgcagatgtcttccccaccgagtgcggctcggcacagcctctgcctccagcccgactctggagggcccccagagttggggagcagcccgcccgtcctgtgctccaactcttccagcttgggctccagcaccccgactggggccgcgtgcgcgccgggggactacggccgccaggcactgtcacctgcggaggcggagaagcgaagcggcggcaagaggaaaagcgacagctcagactcccaggaaggaaattacaagtcagaagtcaacagcaaacccaggaaagaaaggacagcatttaccaaagagcaaatcagagaacttgaagcagaatttgcccatcataattatctcaccagactgaggcgatacgagatagcagtgaatctggatctcactgaaagacaggtgaaagtctggttccaaaacaggcggatgaagtggaagagggtaaagggtggacagcaaggagctgcggctcgggaaaaggaactggtgaatgtgaaaaagggaacacttctcccatcagagctgtcgggaattggtgcagccaccctccagcaaacaggggactctatagcaaatgaagacagtcacgacagtgaccacagctcagagcatgcgcacttatgatataaacagaggaccagctccattctcaggaaagaaatgttgtgatggcaagccttacccaaatatcgtttacacagagagatgactatggcagtgatgtttaatattattaaatccaggcatttcgaatctgtttttcatgatttatagagggtttacacaaagtgccacttattaaagagcttccacagtgaagatggagaaggtgaacttgctttgaatattccagatgtgtttggtcgtgcgtatggcagtgagcaggtatgtgtttgcttttgcttgcactgaaaattaaattgctatcaagagcaaactatgaacggttttttattcaagatgtctccagagtgaagatgccgaggatgaacttgcattgaacattccagatgtgtgagatcatgtgtattacagtgggcaggtatttgcttttgcttgcactgaaaattaaattgctatcaagaataaaccatgaaacattttatcctgaacagccacagtgcctgaattcactcaagtggataaaaagtgtattttaactctgtatatattacccttaagtcattttcctgtcttcactaatttagcaatgcattcatattagctgatgaaaataggcactcacaatgacaaccagagccagtttcttgtcttttttatacattttgtcatcccagagacaatcagtatgtgcttacctgtgttcaagtagagaaaaatacagtagagtctgataggacatattcttgtaccacagacaaaacaaatcttatgttgcatttactatcaactgctgctaatacgttattataaaacttacctagctcctgaattcttcctatcttatagcttaaaacaattaggatcataggcaaatcagttaccttgcagaaagagctttgtatgacagacattgtcttattttatttctgtaaaatattagctgtatgaatatgatttaattaacaagaaaacatttcttcctgattgacaacagtgttagacaaggtgcaaagcgaaactggttgctcaagttgatagaaaacaaaattctgaatatcttcaaattaaattcggtaaaaacacattattttttcatatgtgatgtattcatgcagaacaactatctttgtattttgtttttaaaatgtgtttaataaatgatcctttgtaaataa

SEQ ID NO: 17820 - DNA, 4257 bp, Homo sapiens
aaggcggacaggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacattacatggttagaaaatgtcagtgttaaagaatggtacaaagtgaaaagtgtatccctctcttgccgccggtggtagcttgtcccagtggaagctgctgttaacaatttgtgcccccacatccccctccctgcccatccaccaaaaaaaagtacatttacttatgtaaatgtacttatggtgatgtatgtttgttttggcctcacagcatctgtttccccttaatttggtagctgctcacatttccctcgaaagaaccacaccctctgcattctcagttctctgctttggatgggacatttgccctgcagtccccccaccctccaggccatgccctctccagggtgaggcctgtgtgatctaccgtactagggtactaggccctgaaagaggcttttcttgttcctcctgcatcttgaacctggagcgggagctgttgtaggccccgcccttggagaagagaactgtctgacagtggggagagagcgccacaccctggtggcataaacgagtccctgaatcatgccgtggctgaaccaagccctgtctgtgggctttttctgttgtactcagggcagtttgatggggttactgtcctgcatagccataatggcccagtataaagcagctgttttgatgagataattgctttaattaagcaaaaggtagcaaagctttcactccgccctgtaccttctgtttccacttaggagccttcccatgtcagaatgtgcagatctgtctcattgtttcctgtgcagtgtgcccccacttcacccagtagtttctgtgtgtctgttatgtactaggtactacaaggtgccaggacggtgtagatacagcctctgctatcgtaaaactcaatgattcggtgggggaagacaaatgtcagtaatgtacaaagtaaaatggcagctgttagaagtatgaaaggggcagggtagggggaggtagaatcttccctgaccaggttaagaaaaccagaggccttctctgagggcaagaggaggagaggagaaatagagtaaggcaggcagaggaaacagtctgagctaagaccctgtggctagaagtggcagagggagaggcagcaggaaggccagcggggaggctggggcccagtgcaggcccaggttggaggagcgtagcacatggagtttggtaggagtttgggacgccctggtggatcttaattgtgatggggtgggtgtgaaaggcagtccaggttgcactggttgcacaggagaagtgatcagaagaggaccccagcaggtgtgagccgtgagctgggaggtgcttcagtagtgcaggccatagctgaaggtgtcctacatcagcagggtgatggtgaggtttgaaccactgtttcactgcatagtccctgctgatggacacttgagtgttcagattttttgctggtatattcagtgctgcagtggacattttcatacaaaatatttcggtacacttttgtttatatctgaaaggtaaattcctagcagtagaattattagagcaaacggaatttaacattttggtgtgtattgccaaattgccctcccaagtggtttagtcagcttacccttgccaacaatagatctatccttgccagccttgggcatcacatttaccagtttaatagattgtaaaaccatatcttaattggctaccctgaagccaccatactggagaggctgcgtacagtgtttcacgtagagagagggatacccaggaggcccacctgctccaaccccagctgcatgagtcttcccagcccaggcacagacatgtggataagatttaaacatttccagccccagccttcaagcaatcctagttgacactgaggggagccaacataagctgagctgagaaacagtctgcccagtctgcagattcatgagcaaaagaaatgttgggctgggtacagtggctcacgcctgtaatcccagtactttgggaggccgaggtgggtggatcagttgaggtcaggagtttgagaccagcctggccaacatggtgaagccctgtctctactaaaaattagccgagtgtggtggtgcgggcctgtaatcccagctactcaggtggctgaggcaggagaatggcttgaacccgggaggcggaggttgcagtgagccaagatcaggccactgcactccagcctggatgacgggatgagactctgtctcaaaaaaacgaaacaaaaattttttaagagaaatgtcatttgtttttgtttttgagacagggtctcactctgttgccctcactagagtgcagtaggatcacggctcactgaagtctctacctaccggctcaattgatcttcccaccacagcctcccaaatagctgggagaaatgtcctgtttttaatgaatttgtcttcctttttgtcttgtttgttttaatatctagtgatctaataaatttggatgatatcttttgactatc

SEQ ID NO: 17821 - DNA, 2941 bp, Homo sapiens
ggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttgacccctgagccccttccagtgctgcctgaggtgccctctacctgtgcctgcctctcgtctgccagtttgatttggacctgtttttcccacctcagcccccatgctcttgtcaaacgtgtttggcctccagccaaacagggcctgggaggaaaagagagtcctgcttctgcctggcttccccatcggggaggggagttgaagtgacagcctcctgacagcttagaaatgtggaggacgcagcaagttctggacatggccagccatatgaatgatatcttctctttctttgaaccatctccacctgctcttatggacaccccgccttggggcaaggcaagggatgggcacaacttggaagattttggctttgtgatcctcagtgtccagtgtcacccagatgggccggaagctgcctttgaagccaacgaatgccatttgctctgaaaagcaatgatgagtctcctgagcaaaagccctatgagaggacggctgccccaccccgttccatggctccccatcgccagccccccacgcccaccaggtaccgcctagccacactgcactgtggccccttgggaagagctctgtgctcagctactgatggtgcctgacatgtgtttgtatggggcaggcagggtctcacctgagcctcactgccacctaggcagggtgatggctttgttgtagacaggggagccatgcacagcaggaaatggggcaaactgtaagggaggagacctcctaggaacctgcctacctttgagctgcccctaggacaaccagcaagtccctgcccctctctgaagcccagtgttcccatccatcaaatgatggcattgatctacaagatctccttccccactctatcactctgtggctctagaaagagttctgagaggtgaagaaatttgaccaagagtgtggagtaaatggtgcaccccagattagaactctaaacccctgaaacccacacagcactctccatcttgcagttcacagcttgagcatccgaggggcatgggaatccacgtctatactcagcccatcttggcaggcaacatgcatttatcaccaccgggaaagtgccattcaacttaggtcaccttacatacatcagcttttggcaaccgggatcttaatttaaaagacagaggctccaaaatgatttcaggactgggctggaaaggatacttctcttttccttatgtcctcctttggctggtttgaagggtttgcattgcttctgatttttctcattgccccatatgatgggtttctgattttgatgttttccatagtgaggatggtgtataactaagaagcccagctttgagttaggaagattaggatccaagtcctaaccttaagcaagtggcttggctgttaaattcttggtgtcctcatcttaaatggaaataatagtacctgctgcacaggttattaatgagtaagtgagataattataacatgttgtgcaaagtgcaaggctgaacattgaatagcaaccacaatgatcattatcattattgcccgtggagcttctctgccgcccatacagcctctctgaggactctccctgcacctagtttttgtgatgataatgggtgtcatgctgacatgtccctcctggatggcttcttccagcacagccagcaagcctgtgctaggcttcaccaccgaagctgcctggccttggacaagccatgtaggttctctgggctttagttttctggaacaaataagagttttgcaagctgcaaaggactgtacaaacgctaggcatcagctagaatgttgaagaagatgcaggacccctggccagtctgaatagcaggaattgggtaggagggtgagactaagccacttttcttatgatacttttgttgaataaagggccactttccaagcaaa

SEQ ID NO: 17822 - DNA, 1552 bp, Homo sapiens
atggcccagtcgcctcctccgcagagcctcctcggccacgaccactggatcttcgcccagggctggggctgggccggccactgggactccacgtccccggcctcctcctccgattcgtcgggttcgtgcccctgcgacggcgcccgcggactcccgcagccacagcctccgagctgcagctcccgagccgcagaggcagccgcgacgacgcccagacgagcgcgcaccggaccagcgggcggacagcggcagagcgccagcgagcgggagaaactgcgcatgcgcacgctggcccgcgccctgcacgagttgcgccgctttctgcctccctccttggcgccggccggccagagcctgaccaagatcgagacgctgcgcctggccatccgctacatcggccacctatcggccgtgctgggtctcagcgaggagagtctgcagtgccggcgcaggcagcgcggggacgcggggtccccttggggctgcccgctgtgccccgaccgtggccccgcagaggcgcagacgcaggcggaggggcaggggcaagggcaggggcaggggcaggggcaagggcaggggcaaggacaggggcaaggacaggggcaagggcaggggcgcaggccgggcctggtctccgccgtcctcgccgaggcgtcctggggatccccgtccgcctgccccggagcccaagccgcacccgagcgcctggggaggggggtccacgacacggatccctgggcaacacccccttactgccccaagatacagtcgcccccgtattcgtcccaagggacaacctccgacgcgtctctttggacgccaccccaaggctgtccctggacgcagtcgtccccagagccccggaacccaccagtgccctggacggcggccccagcaactttggagctggccgcagtgtaccagggtctctctgtgtctccagagccctgtctgtcgctgggagctccatctctcctgccccacccatcatgccagagactgcagcctcagacccccgggaggtgctggagccacagtgcagaggtggtgcccaactcagaggaccagggaccgggcgccgccttccagctcagtgaagcaagccctccccagagctcaggcctgcggttcagtggctgccctgaactttggcaagaagatctggagggggcccgcctgggcatcttctactaaatggcctcggcttccctctttccatccaggaatcagtcctgtagcttgggtgcctccttatttgttaattagtggcttttcatgttctcctttagccaaggctccctttttccaagtgatgtctttcagggaagcagtgtttgaaatagatagcgggtaccttccctggatggagtcagggcgggggcactgtcctccactgctagacacccccagaatgcctggcgctctgcagagcacagtctgagctgctctaagaaggggtctcctttaccctaaaggcagctgggcagggacaggtgggagaatgggtgtaggaggcaggccccaggctctgcttcttggtgacagttggcca

SEQ ID NO: 17823 - DNA, 2465 bp, Homo sapiens
caaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 17824 - DNA, 2409 bp, Homo sapiens
agcacatgctgggctcgggggcgatgggcttgtgcgcggacctggcgacgctctagccccgagccgcgtattcgtggccgggtcctccctgggaacagggtgaaggccgagaacctctggcctcaggaagcgcatgcgcaaccggttctccgaaacatggagtcctgtaggcaaggtcttacctgaatcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 17825 - DNA, 2367 bp, Homo sapiens
cgctgctgtggccaggcgtctggcatgctgaccacgtcgcgctgctgtaaaggaaacctgccccgcgcagcggcggtggctggagcgggagaaaccggactttgtgcaactttggccatagtggccatcccatgaatctgtttactagcttggtggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtg

SEQ ID NO: 17826 - DNA, 390 bp, Homo sapiens
tggttcagggagggggacagctgaagaaggtgtgaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgt

SEQ ID NO: 17827 - DNA, 776 bp, Homo sapiens
gctgctgtggccaggcgtctggcatgctgaccacgtcgcgctgctgtaaaggaaacctgccccgcgcagcggcggtggctggagcgggagaaaccggactttgtgcaactttggccatagtggccatcccatgaatctgtttactagcttggtggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggg

SEQ ID NO: 17828 - DNA, 582 bp, Homo sapiens
gactgtgcctgtgctgaagccctttcctcctcctagctcccaggcagctagaaaattgcctgtctgaaagaaagtagctgttttccttaggggactgtggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccat

SEQ ID NO: 17829 - DNA, 555 bp, Homo sapiens
attccgcgcccgctctgcctacttgaggagggggtgtcactcctgcccgcaatggaatgttcagaacgcgggacctccttgggttaggatttctagaccccgggatcgtcgtgggattgttcaccttggtttcgcgggttttcaaagtggttcgtctcgcggcgacgccatcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggct

SEQ ID NO: 17830 - DNA, 541 bp, Homo sapiens
aaaatcaattctcacacgctgggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtaattgcct

SEQ ID NO: 17831 - DNA, 2180 bp, Homo sapiens
ccgaaacatggagtcctgtaggcaaggtcttacctgaatcagtgggtctctgcttttcctacaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 17832 - DNA, 2158 bp, Homo sapiens
ccgaaacatggagtcctgtaggcaaggtcttacctgaatcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 17833 - DNA, 606 bp, Homo sapiens
ccttctgcagctgtctcgcaggcatggacaacctgcgcgagactttcctcagcctcgaggatggcttgggctcctctgacagccctggcctgctgtcttcctgggactggaaggacagggcagggccctttgagctgaatcaggcctccccctctcagagcctttccccggctccatcgctggaatcctattcttcttctccctgtccagctgtggctgggctgccctgtgagcacggcggggccagcagtgggggcagcgaaggctgcagtgtcggtggggccagtggcctggtagaggtggactacaatatgttagctttccagcccacccaccttcagggcggtggtggccccaaggcccagaagggcaccaaagtcaggatgtctgtccagcggaggcggaaagccagcgagagggagaagctcaggatgaggaccttggcagatgccctgcacaccctccggaattacctgccacctgtctacagccagagaggccagcctctcaccaagatccagacactcaagtacaccatcaagtacatcggggaactcacagacctccttaaccgcggcagagagcccagagcccagagcgcgtgag

SEQ ID NO: 17834 - DNA, 2112 bp, Homo sapiens
atgtggccccaggctggcccaggacagaggcgtggggtgggagcagggggtcccatcctgagtcactgccctccacagacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggctcctcggcggcccctcccacaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 17835 - DNA, 2092 bp, Homo sapiens
ctctacttcccaggggaggaaaccgaggcacacctgtagccagggagcagggggtcccatcctgagtcactgccctccacagacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 17836 - DNA, 2116 bp, Homo sapiens
ctctacttcccaggggaggaaaccgaggcacacctgtagccagggagcagggggtcccatcctgagtcactgccctccacagacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggctcctcggcggcccctcccacaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 17837 - DNA, 2169 bp, Homo sapiens
tgccaggctctccacccccacttcccaattgaggaaaccgaggcagaggaggctcagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 17838 - DNA, 2109 bp, Homo sapiens
ggctgccaggctctccacccccacttcccaattgaggaaaccgaggcagaggaggctcagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagaca

SEQ ID NO: 17839 - DNA, 4125 bp, Homo sapiens
gccattcggcaccggagtcgctccgcgctcccagaatgcaccggcagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattgcagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttctttttgttttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtattttttaaagagctaa

SEQ ID NO: 17840 - DNA, 1951 bp, Homo sapiens
gctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattgcagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaa

SEQ ID NO: 17841 - DNA, 1695 bp, Homo sapiens
aaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattgcagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgt

SEQ ID NO: 17842 - DNA, 3845 bp, Homo sapiens
gctgccattcggcaccggagtcgctccgcgctcccagaatgcaccggcagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgaggagccactggaagtggggaaatggtctgtacaatatgtcaagaagagtattcagaagctcccaatgaaatggttatatgtgacaagtgtggccaaggatatcatcagttgtgtcacacacctcatattgattgcagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttctttttgttttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtattttttaaagagct

SEQ ID NO: 17843 - DNA, 4046 bp, Homo sapiens
gctgccattcggcaccggagtcgctccgcgctcccagaatgcaccggcagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattgcagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttctttttgttttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtattttttaaagagct

SEQ ID NO: 17844 - DNA, 2366 bp, Homo sapiens
ccctaacgacagctcgcccgtgcttcgccctcgcagctctcctgtgtccccaaaatgcctttcccgcgtcccccgcccttcagcggtgactgcccaggggactctgtaacgcgacactcagactgccgagcctgccaggcacttcgcggagggcgctaggggccgggacgcggccgccgagcgtaggttccggcctttactccgagttgcgcacggagccccagctgcggttgtccgctctggggatcacaggccgcggagacccgggagccacccgccgggccccttcagacgacccgcttccgcaaaccggccgtgggactccggcgccgggcggacgaagcggctccgggaagactcggtcttccccgcccgcctgaggtcgccggggcggggcttcagtgacaggcccgcgcgctaccgcggaaacaggaagttggctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctg

SEQ ID NO: 17845 - DNA, 2617 bp, Homo sapiens
gcacttcgcggagggcgctaggggccgggacgcggccgccgagcgtaggttccggcctttactccgagttgcgcacggagccccagctgcggttgtccgctctggggatcacaggccgcggagacccgggagccacccgccgggccccttcagacgacccgcttccgcaaaccggccgtgggactccggcgccgggcggacgaagcggctccgggaagactcggtcttccccgcccgcctgaggtcgccggggcggggcttcagtgacaggcccgcgcgctaccgcggaaacaggaagttggctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaa

SEQ ID NO: 17846 - DNA, 1910 bp, Homo sapiens
accgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagagatggagttttgctgtgttgcccatgctggttttgaactcctggcctcaagtgatcctccctccttggcctcccaaagcattgaaattacagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctctt

SEQ ID NO: 17847 - DNA, 1898 bp, Homo sapiens
gccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagagcaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatat

SEQ ID NO: 17848 - DNA, 1667 bp, Homo sapiens
gcacttcgcggagggcgctaggggccgggacgcggccgccgagcgtaggttccggcctttactccgagttgcgcacggagccccagctgcggttgtccgctctggggatcacaggccgcggagacccgggagccacccgccgggccccttcagacgacccgcttccgcaaaccggccgtgggactccggcgccgggcggacgaagcggctccgggaagactcggtcttccccgcccgcctgaggtcgccggggcggggcttcagtgacaggcccgcgcgctaccgcggaaacaggaagttggctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagagcaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttag

SEQ ID NO: 17849 - DNA, 4236 bp, Homo sapiens
aagcaagtgcataataaatattatagttatcctgattgtctcctttattcatcacacacttcctaagcacatctctggagggcactttccaaggctccgggggaggagaggaaagaggcgcagccaggcctggtgggtcccggaggggcagcgcggcgcgggaggggaacggggaggcacggcctggctgccaccgcgcgcggaacccgggagcggctccggggctgtcagctgcccgcctggctcctccaaggcctggagctcggacgcgggctctgggggcttctggggcgcggaagcgggctcgcggggagcagtggccgcccccggccgccgcggtggctgtgctcagaagccggccctggcgtcaggaggccgggcgcgcggcgcggggcgcgagttcccctgcccgcctgtgcgccccgcaacgggcctttcctgggccctaacgacagctcgcccgtgcttcgccctcgcagctctcctgtgtccccaaaatgcctttcccgcgtcccccgcccttcagcggtgactgcccaggggactctgtaacgcgacactcagactgccgagcctgccaggcacttcgcggagggcgctaggggccgggacgcggccgccgagcgtaggttccggcctttactccgagttgcgcacggagccccagctgcggttgtccgctctggggatcacaggccgcggagacccgggagccacccgccgggccccttcagacgacccgcttccgcaaaccggccgtgggactccggcgccgggcggacgaagcggctccgggaagactcggtcttccccgcccgcctgaggtcgccggggcggggcttcagtgacaggcccgcgcgctaccgcggaaacaggaagttggctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggttttttttttttttttttttggcctgagtctcactttgatgtccaggctggagtgcgatggcacgacctcggctcactgcaat

SEQ ID NO: 17850 - DNA, 582 bp, Homo sapiens
cacttgcagcctcggacgcgcggcgaggcggccgccgccggaggagcccccgcccctgcgcgcctccctcccgggagcccctgcctccctcggtgcgcgctgctgctcgcagccgccgcggccgccgaagaggagcccggggccagtctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttca

SEQ ID NO: 17851 - DNA, 949 bp, Homo sapiens
acttgcagcctcggacgcgcggcgaggcggccgccgccggaggagcccccgcccctgcgcgcctccctcccgggagcccctgcctccctcggtgcgcgctgctgctcgcagccgccgcggccgccgaagaggagcccggggccagggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacagg

SEQ ID NO: 17852 - DNA, 2729 bp, Homo sapiens
agcaaggcagggcctctttacactgggtgtcgcgccgtctgagttcctgacttgtttacccatcccgttggggctccggccgctgcaggctacctgctgtgcccgggattggggacctgtgactcccgagtggaagagatggtggcccaggaggaggaccccgacctattcagactgggagctggggtcagagtgtctccgtctccggagggggaccttccagaccccgggcgggaggggcccacagcagggtgccccggcggccccaggagggggtccgggcctcgggcgaaggctgcggcgccccggaaggagccgcgcacgcccctgcacgcggtgcccgctgcggaggccacggatccggagtctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgcccctgggttggggtgggtgggaggattcgtgagctgcacacagacagtccctttctctcctcccaagtgagggaggagacaggcccaaggcggaggccctccgagggagcatttagggacatctcaggaattcagaccgcacctggccaggcccacagctgtttgcctggcattgttcccccctttttcttcccataggcatttttgtttacttgaacaatgacctgagtgtcctaggcattcactcggagcctggatgatgggggctggttctacagaatgagccactggcattcgtgcccaggaccagtgagagcgttcccagtcatggggggatgacccttggtcccacggggaacacactgctctgtagaatgcggtagcctggatggagggtctgcaggcttaggctgcagcaggcctgccatgggtgtgaacccatgtccaggcacgcaccgacacacatgcacgcacgcacccctcttaattgaaccaagtgggtcctgtgtttctcttttctgccccgtagtgaggttctgttccttggtgcggcttcccttgcaccgttaggattctgtctggcatgcctgcagccgaggaagcccaggaccagccggccctgtgaattggagggtggcacagggaccgagcgggccccaggctccagcagccccaccttggacagcttctttttcttctttgaattaggactggagggggtggggccagggcggtggtgggaaccggtagggcctagatgaggggcaggcagtcaggcagaaatgggcaagttcagggtcagattctgtcgttatttaatattttgttcatcatggactttttctgcatttattttgatttttaacgttgcattaaagtagtattatttgtcctga

SEQ ID NO: 17853 - DNA, 1074 bp, Homo sapiens
acttgcagcctcggacgcgcggcgaggcggccgccgccggaggagcccccgcccctgcgcgcctccctcccgggagcccctgcctccctcggtgcgcgctgctgctcgcagccgccgcggccgccgaagaggagcccggggccaggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatggg

SEQ ID NO: 17854 - DNA, 2507 bp, Homo sapiens
acttgcagcctcggacgcgcggcgaggcggccgccgccggaggagcccccgcccctgcgcgcctccctcccgggagcccctgcctccctcggtgcgcgctgctgctcgcagccgccgcggccgccgaagaggagcccggggccagtctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgcccctgggttggggtgggtgggaggattcgtgagctgcacacagacagtccctttctctcctcccaagtgagggaggagacaggcccaaggcggaggccctccgagggagcatttagggacatctcaggaattcagaccgcacctggccaggcccacagctgtttgcctggcattgttcccccctttttcttcccataggcatttttgtttacttgaacaatgacctgagtgtcctaggcattcactcggagcctggatgatgggggctggttctacagaatgagccactggcattcgtgcccaggaccagtgagagcgttcccagtcatggggggatgacccttggtcccacggggaacacactgctctgtagaatgcggtagcctggatggagggtctgcaggcttaggctgcagcaggcctgccatgggtgtgaacccatgtccaggcacgcaccgacacacatgcacgcacgcacccctcttaattgaaccaagtgggtcctgtgtttctcttttctgccccgtagtgaggttctgttccttggtgcggcttcccttgcaccgttaggattctgtctggcatgcctgcagccgaggaagcccaggaccagccggccctgtgaattggagggtggcacagggaccgagcgggccccaggctccagcagccccaccttggacagcttctttttcttctttgaattaggactggagggggtggggccagggcggtggtgggaaccggtagggcctagatgaggggcaggcagtcaggcagaaatgggcaagttcagggtcagattctgtcgttatttaatattttgttcatcatggactttttctgcatttattttgatttttaacgttgcattaaagtagtattatttgtcctg

SEQ ID NO: 17855 - DNA, 728 bp, Homo sapiens
aaattgtatttgaatcctgagcaaccacagccctctagcctcttcccctccctagccatatctgaacagcttcccatttcaactccatagatacgtgactctccaagtgctttattttgaaaactaggacgtagcactttgcagaagaaaaatcagtccacttgctattatttatgtgatcgctgatctgctagatggatatagaaagcaccaagaattataataatttatggagtagagcactggtttacaaacatatttctctgcccgagctttgtgtgtttctttgcgtctcggggctcgttctgtgcaatgggaatggagaatattcagaatttgaagacaagcccggcgagccgactgcattcatagctaaaattaaaggaataagtgagcagctatttgtggcagacaggacatgatccatctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagat

SEQ ID NO: 17856 - DNA, 1838 bp, Homo sapiens
ttttctctgcatcgccctgagccaccggcctgaagacaggcagctgcacttttggctgtcccatcagagaggctggggctattcagtcgctcctactctcagttaaaggccccaagaggagacggagccaaggtgcgtctaggatcctggtgaaagctttccaaggtggggttcctcagaacgccgcagcggggatggctgttgggggagatgtttctctggaagcttctcatgcttaataagacagtcgtttctgtgtgctcattgactgtcatccgagttttggacccaggacagcaccatattatgctagccccccagtgattgttaaagagctgccgatgaatggaagagaaacacagtctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgcccctgggtt

SEQ ID NO: 17857 - DNA, 1483 bp, Homo sapiens
gtttctttgcgtctcggggctcgttctgtgcaatgggaatggagaatattcagaatttgaagacaagcccggcgagccgactgcattcatagctaaaattaaaggaataagtgagcagctatttgtggcagacaggacatgatccatctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatg

SEQ ID NO: 17858 - DNA, 1898 bp, Homo sapiens
acttgcagcctcggacgcgcggcgaggcggccgccgccggaggagcccccgcccctgcgcgcctccctcccgggagcccctgcctccctcggtgcgcgctgctgctcgcagccgccgcggccgccgaagaggagcccggggccagtctgtttccaggtctggcggggggccgggctgcggtggcggcagcggtgggagatgccggggcggccggcggaggtccatgtggcgctcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgcccctgggttggggtgggtgggaggattcgtgagctgcacacagacagtccctttctctcctcccaagtgagggaggagacaggcccaaggcggaggccctccgagggagcatttagggacatctcaggaattcagaccgcacctggccaggcccacagctgtttgcctggcattgttcccccctttttcttcccataggcatttttgtttacttgaacaatgacctgagtgtcctaggcattcactcggagcctggatgatgggggctggttctacagaatgagccactggcattcgtgcccaggaccagtgagagcgttcccagtcatggggggatgacccttggtcccac

SEQ ID NO: 17859 - DNA, 2252 bp, Homo sapiens
agaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggaccccgtggtttaatggatggggctttaacctacccagaggtcagtctctgctggacaagtggaacctcatccctgagggcattgacatactcatgacacatggacctcctctaggttttcgagactgggttccaaaggagcttcaaagagtgggctgtgtggagctgttaaacacggttcagaggcgagtccggcccaagctccatgtgtttggtggaatccatgaaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttcttttaaaaagtgataaaagtcttattttaatatgctttaagctgaaagaaaaaaaaataagaaacaggcagtgttttaaaaaccaacacagatttgcacaactgtttaagagtattgtttgaaatattttaattttcaatgttttgttgttgttgttttcttggtaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagtgagattcctattgtggttatacaaggtctcattgtttgtttgtttcttttaaattatttcagctttaaaaatacagaaatggaatctgtcaagagcaggtatttcatacggttaaaaaaatgaacatgcagactccttttcaatatgggtttatatatataagtattttttgtgtattatgactacgttaggagtttattattgtcaaggacagtacaactgcaaagggatgctgtatagcaacacatcagaagtcggaaggaactgacacattctctcagagctcaaggtcttaaagagcttgagttaaatctaggtacagttacaggcatgtatagacttaaatggatgcaatggaagctaactaaaataaggcttagttgtcctttctatttaaataccccaagttgtcttcttacttcctctcccctctcccattttgcactgtgtgtcgatgcaatcttcgctagcacaaaatattgtcgctaatagtcatttctgttttcccattgtaaatgctgttgagctttattctattttatgttactttgttaatgaaatttaggaaagcagttgtttctttaaatttattgtgatattctatatctagcggcctttatatgcaaataaaattgcaagatttttaaa

SEQ ID NO: 17860 - DNA, 5591 bp, Homo sapiens
cccagatcgaggctgctcgggtcctttctccccccgcctccctctagcgccgcgccccctggcccccagccccagcctgcggcgggacctccggggtcgaaggttctggcccgctcgcgcccctcgccgcccccgcgcgcccccagcgctcctccagccggctcgggccgctcggctatggatcgcctgctcgccgggcgctgaaggcatccccgggatccggagcgcagcccgggaaagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggaccccgtggtttaatggatggggctttaacctacccagaggtcagtctctgctggacaagtggaacctcatccctgagggcattgacatactcatgacacatggacctcctctaggttttcgagactgggttccaaaggagcttcaaagagtgggctgtgtggagctgttaaacacggttcagaggcgagtccggcccaagctccatgtgtttggtggaatccatgaagtaaaccctgtgagcatctccaaggcactgaggacaaaaatatgttctctgccttcaaaaacttcctagtctagaggaaactggcatagacacaattaattgatgatctgatgaattagcattgtgtgagctacaatcctggcatgaatcaagaactagagaggcacacaggaaggaaggaagatgcctctccttggtgaagacaaagaaggcatgaggaggaggcgacagggaagctcacctggtggacaacaggaaagactgcggaggagggctctgctggaagaggaaacagactggggaggtggggccagtgcataaagggccactgcaggaaggggttgtaggagaaaaggaaagacagatcagtcactgatgaccccctccaccccaggtctgcagacagagctgattccttctctaagcctcggcatcccctaccaacagtccctcctgctccttctctcccaagtcctctaaacagcttcatgcccaaaccacaaagagaacattctcaggcctaaggcaggccttcccagcacagaatgtttggagccctctgtgggagagcggctggcccccttaactgtcccccttccctccgggagccaaggcaggcactgtgcacctgcccctgaattgtgtgcggcagttgccggcctggagctgagtgacacagcaggtgcctccagcctgaagacaattccatatttcaatggagcgtcgccaccaaagcttattatctagggcaataaagtttaggattagggggattcaggatgattgtgtgattctccacaaagcttatcttctaatagaccagctgctttattaggccgcccccacccgcaccaggcccttcccaaagcatcccaagtcccaggcagccgacgggggccttgaaggcggcagtggtagacagctgggggtatcatatcaccctcagtctccatctgcgattattaaattacgggcggcttccagctgggcacaccccagctcccaccttcctcctacaaagccagcatcatcgtcaggcatctgccaaggacacgatgtggctgcctctcccctgctgatccctactgttgaactctaaaagggccaggtctgggtatttacttgctattagggctgtcactgtcacagtgtggaatgcagtggagtggaggcctggagagagggggggaccatggaaatttctgttgcaaatggggctttgctgggactgttcactataaacaaaaaaagaagatggaatcatgcaccacagaacctcaaagaagctggcatgcttaccaagctcccacatatttctcccaaaatgaaattcattaacgttgagtgttctagggaccacctccacatgctccctgatcccattgctccgttccttttctgatgggagcagagcatgggatggtgtctctccaaccccgtgtggtcagcagcactgaggctactctcgtttcctatccctccctgacagtctcctttatcctcagcccctgacagactatctgttcagagtaggaatttatcaataagtactgataagcatgctgaaaggaatatgggggactgggaatatgcctgaaacataatgaatgtttcaaagaaatgaaacgttctgaaaatggaattttcaaagattctgacaagcacacagcatctgcttgcagattttaggaaaacttagtcatagaattattcagagttcacatttcagccatggggatgttgtgtgcctgttgacagcagaggtccctgtagacgtttgttttttactgtgtctatgtgtgattcactaatgagagagtggcttagatgctcagagtaattaattgtagtattgagataatagtggctttgaaatccagctgtgcttatatgcgtgcacgctgtgcagttagatgctcccaggttcagatctgcttccatcactactaactatgtggccttgttttctgatctgcaagccatggattgtattgcttactttgcgggactgtggtaaacgttaggcatatatgaggcaagtgcaatgcccaacatttggcagatgcttaataagtgttggctattattattactactactactactattgcttttgctattgctattatgtgtgacctgtataataatcctactaatatgagtgaaggcaagaatcatggactatgcacccagcataatcaggagggtttgactgttgtgaatgaattcaagggcaggacaagcagcgacaagagttactgaagttcatctgatttgagttctgttcattcatttatttgggatccaaattctgaaccccagctctgtgctagacactgttctaggtgctgggaaaacagtcatgtgttagtctgtttttgctgccataaaggaatccctgagactgggtattttataaagaaaagaggtttatttaaatcacagttctgcaagcctaacacctggtggaagctgccaaggcttacagcttataccctctcaagcagcaccctaatctataccttgagccaagactggaattggagctgccatgatgcaggaagcagtgtcccaaggatgtgcagagcagtggggtcctgaatgtggccccccaaaccattcttttctcctaggcctctaggcctgtgatgggggggtggccttgaaaatctctgaaatgccttcaaggcctttttcccattgtcttggttattagcacttggctcccctttagccatgctaatctgtctagcaagtggttgctccacagcctgctcatatttcactcctgaaaatgttctttccttctccaccacacaaccagtttgtgaattttccaaacttttatgctctgcttcccttttaattatcaatttcccagcctcagatattcctttatagtaatgcaaatggactaacagaagcaatgaataagaaggggtcctggcccctctacaactcatcttctattgagaaagaaagaagaaaaaatgaaaataagttaaaaaaactcaaattttgataaaccctatgaagaaaataagaaatgggatagaagttagctggcatggcagggtggagtgggtgagtgacattaaggagggtgacaacagagaaactttctgataaaaaacccagtaagtaaaggtctaagtgatgtggatgaggcagccacttgaagacctgggacaaaagtgttcaggcagagaatatagcaggtacagagctttttgtataagaaggtagcaaaaaggccagtatagccagagaacagaggaggtaaggagaaagataggggatgaggcaggtgctaactcatcaacatccttgcaggccttgatgagagttaagatttcattataattgcaataagaagacagtggaaggttttttggcgggggtgggggtggtcaatgacatgattggattgatatgttggaaaagcccatctggcgactgtgttcagtaacagtgtgcttgcatgaagatccctcacagcagcagacaacacaaatgccccctcccacccatcatgaaaatttggaaagccaagccaataggaaactgaagctacaaagacccagcccctagaaagcaatataaacaagaccagaaaaagcatgtgttcaggacaagttcacattgaagtaaaaccatattgacattgattgcattccctacctgcttaggggttttgcttcacctaaactagtaccttgagaatctgtaaaagcttacaatttgagaaaagcaagagatgacacctgattatcctttgaattggcttccatgtctgtggctgttttccctaagttcctgtcccttacacacacgttacaaaactttgtctcaattctttgcttttaaaggatttgactttaacaaattcacattgggtacttgcttagtaggaaaggaaataatgactctcaccccctatgttataaaacttttaggagtattacacacaggcacatacagggcacactggtatggcttgtcattttgtgacaaattcttgtcagtttgtggtctggtggaaagcatatggaattagcaatcaagaaaggtgagatttagttctggctctgcttctaactagcaatgcaatcttggacaagagatttattctttcaagtctcagtttcatcttgtcatatggacatagagtgatacttccttttaaaagaacctgggtatcctggccaggcgcggtggctcatgcctcccagcactttgggaggccgaggcgggtggatcacaaggtcaggagatcgagaccatcctggccaacatggtgaaaccccgtctctactaaaaatacaaaaattagttgggcgtggtagtcccagctactcgggagactgaggcaggagaatttcttgaaccctggaggcggaggtagcagtgagccccgaggtcgtgccactgaactccagcctggcaacagagcgagactctgtct

SEQ ID NO: 17861 - DNA, 381 bp, Homo sapiens
agatcagcagatgggagggaacctagggtcgccttcctaggtctgagcgaagtgtcccagccgctccccttacccctgcggtgagccctgcgtcctggaacggtgccaggactcctgacagagcctggcagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatg

SEQ ID NO: 17862 - DNA, 394 bp, Homo sapiens
accaagccttccacgtgcgccttatagcctctcaacttcttgcttgggatctccaacctcaccgcggctcgaaatggaccccaactgctcctgcgccactggtggctcctgcacctgcactggctcctgcaaatgcaaagagtgcaaatgcacctcctgcaagaagagctgctgctcctgctgccccatgagctgtgccaagtgtgcccagggctgcatctgcaaaggggcatcagagaagtgcagctgctgtgcctgatgtccggacagccctgctcgaagatatagaaagagtgacctgcacaaacttggaattttttttccatacaaccctgacccatttactgtattttttttaatgaaatatgtgaatgataataaaagttgctgactt

SEQ ID NO: 17863 - DNA, 380 bp, Homo sapiens
cctgccctgacttctcatatcttgcctaggaactccaggcttgtcttggctccaaatggatcccaactgctcctgcaccacaggtggctcctgtgcctgcgccggctcctgcaagtgcaaagagtgcaaatgtacctcctgcaagaagtgctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggatttttttttttaactaccctgaccggtttgctacattcttttttctattcaatatgtgaaagacaataaaacacttttgacttga

SEQ ID NO: 17864 - DNA, 704 bp, Homo sapiens
cggaacacgctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 17865 - DNA, 721 bp, Homo sapiens
cttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagtgagtgcggggccatctccaggaatctggggctgtggctcaggttgggagggaactcaaggctggccctgagtgcatccttctggggaactgggctttctttgccctcattgcccgtgtcattccctctccaggctttctgccctaaattcagatggggcaggacagcatttttctcgtgggacacaaaccccaactgtaccccctatggtttcagaacagagctgtgccagacgaaaaaaagcatcctctgggtctgggttctgagctcgagccaggcttgctattagggcagggaggtgcccggtcaagtctactgccacctctcactctccccttcttccccaggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 17866 - DNA, 440 bp, Homo sapiens
gccccctcccctgactatcaaagcagcggccggctgttggggtccaccacgccttccacctgccccactgcttcttcgcttctctcttggaaagtccagtctctcctcggcttgcaatggaccccaactgctcctgcgccgctggtgtctcctgcacctgcgctggttcctgcaagtgcaaagagtgcaaatgcacctcctgcaagaagagctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctg

SEQ ID NO: 17867 - DNA, 443 bp, Homo sapiens
gccccctcccctgactatcaaagcagcggccggctgttggggtccaccacgccttccacctgccccactgcttcttcgcttctctcttggaaagtccagtctctcctcggcttgcaatggaccccaactgctcctgcgccgctgcaggtgtctcctgcacctgcgctggttcctgcaagtgcaaagagtgcaaatgcacctcctgcaagaagagctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctg

SEQ ID NO: 17868 - DNA, 405 bp, Homo sapiens
actccgccttccacgtgcacccactgcctcttcccttctcgcttgggaactctagtctcgcctcgggttgcaatggaccccaactgctcctgtgccgctgcaggtgtctcctgcacctgcgccagctcctgcaagtgcaaagagtgcaaatgcacctcctgcaagaagagctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttga

SEQ ID NO: 17869 - DNA, 402 bp, Homo sapiens
actccgccttccacgtgcacccactgcctcttcccttctcgcttgggaactctagtctcgcctcgggttgcaatggaccccaactgctcctgtgccgctggtgtctcctgcacctgcgccagctcctgcaagtgcaaagagtgcaaatgcacctcctgcaagaagagctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttga

SEQ ID NO: 17870 - DNA, 397 bp, Homo sapiens
accacgccctccacgtgttccactgcctcttctcttctcgcttgggaactccagtctcacctcggcttgcaatggaccccaactgctcctgcgaggctggtggctcctgcgcctgcgccggctcctgcaagtgcaaaaagtgcaaatgcacctcctgcaagaagagctgctgctcctgttgccccctgggctgtgccaagtgtgcccagggctgcatctgcaaaggggcgtcagagaagtgcagctgctgtgcctgatgtcgggacagccctgctgtcagatgaaaacagaatgacacgtaaaatccaggattttttttttctacaactccgactcatttgctacattcctttttttctgtgaaatatgtgaataataattaaacacttagacttga

SEQ ID NO: 17871 - DNA, 450 bp, Homo sapiens
ggccctcttcccggactataaagagagccgccggcttctgggctccaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttttttttttgtacaaccctgacccgtttgctacatctttttttctatgaaatatgtgaatggcaataaattcatctagacta

SEQ ID NO: 17872 - DNA, 786 bp, Homo sapiens
aagcagcattcccaagtcccgctttcacccgcgcgctaacggctcaggttcgagtacaggacaggagggaggggagctgtgcacacggcggaggcgcacggcgtgggcacccagcacccggtacactgtgtcctcccgctgcacccagccccttccgcgccgaggcgtccccgaggcgcaagtgggccgccttcagggaactgaccgcccgcggcccgtgtgcagagccgggtgcgcccggcccagtgcgcgcggccgggtgtttcgcctggagccgcaagtgactcagcgcggggcgtgtgcaggcagcgcccggccggggcggggcttttgcactcgtcccggctctttctagctataaacactgcttgccgcgctgcactccaccacgcctcctccaagtcccagcgaacccgcgtgcaacctgtcccgactctagccgcctcttcagctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 17873 - DNA, 665 bp, Homo sapiens
gcgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagcatga

SEQ ID NO: 17874 - DNA, 294 bp, Homo sapiens
atggggagcctctggctgctgctcactcagcctcccttccccagccgtgacagcactggagcctttcggacacctggaccatggaccccagggaatgtgtctgcatgtctggaggaatctgcatgtgtggagacaactgcaaatgcacaacctgcaactgtaaaacatattggaagagctgctgtccctgctgccccccgggctgtgccaaatgtgcccggggctgcatctgcaaaggaggctcagacaagtgcagctgctgcccatgaaagccatccatcgtgcccacccctt

SEQ ID NO: 17875 - DNA, 2579 bp, Homo sapiens
actgcccgggcgcctcttcccctccccccaggttcctgtccctcacccttcccccttctccaaccgccaacggccgcctgcgcctgaggcccggcccacgccccatcccgctcgctccacgctgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctgggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtactgtgactgctttgccagtggggacttttgcaacaactgcaattgtaataattgttgcaacaacttgcatcatgatattgaacggtttaaagccattaaggcatgtcttggtagaaatccagaagctttccagccaaaaattgggaagggccaattgggcaatgtcaagccccagcacaacaaagggtgcaactgcaggaggtcaggctgcctgaagaattactgcgagtgctatgaggcccaaattatgtgttcttctatttgcaaatgcattggttgcaaaaattatgaagaaagcccagaacgaaagacactaatgagcatgccaaactacatgcagactggaggtttggaaggcagccattacctgccaccaacgaaattttcaggacttccaagattcagtcacgataggcggccttcctcatgcatctcctgggaggtggtggaggccacatgcgcctgcctgcttgctcagggagaagaggccgagaaagaacactgctccaagtgcctggcagagcagatgatcctggaggaatttggaaggtgcttatcacagattctccacactgagtttaaatctaagggattgaaaatggagtagagtataaagtgtgaatgcatgttgattttgtcttagtctagaaatctctagtttagaaaggatgtttaggggaacatgaggctggctctgcagcaacaaccaggctcccctgcatccctgggcccagggagtttactcagagctctctgaagatgtggcaacccatgcccccttttctgaggaggtgcatggcctgagcattgtttgtctggcccagaggagagagcttgggttcccatagtcctgggagagtgtctgcagggcggcggagggcagagcagggcaggggagggcacagcaggccctgcgaagggcagagcggggcaggggagggcagagcaggccctgcggagagctcactctggtcgactcttcctctcagagaatgttgctctggaggctgctctgcatgaaaaccctaatggtttcttgtttgtttttcaaattatttagaaataagttctccggatgggctgttgtgataccacttaaaatctctagagaactactgaacacctaaagattttctgtagcgtagatatttccccagaggcacgcgaactgtcagtctttcctaaggcccccgggagacgcaggcaatggggcctcgcaggccaggcttgcaccagcatgtcttgagttagaggacttaaaattatccagtttcttctgtgtttctacttgaattgtggaaaagctctattatccaattaacttctccataattattgttgtaatattattattgtttgtaaaacatggttcacataactagcttgtggaaaccagcaggtaaaatgaattcttaagttgacgcttttggttctgttgtaaagcaaagatgaataaaaatttccaatgtcttcaa

SEQ ID NO: 17876 - DNA, 3495 bp, Homo sapiens
acgccccatcccgctcgctccacgctgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctgggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagcttgagggagccttaccatcggtagtcaacgggtctgctttcccctcgggatcaactcttccaggaccaccaaaaataactttggctgggtaaggattagaagcaatacattgtcactctaatgtaataatttaagagactcttggatacgttcacgattttcttctatactataaaatgagcttcactgcacaccttcatgacttctgagaaatgtttttaccatcagcaatgccactaacggtgttgctgtctgtgtctggtttcactggggctgcaaaggctgctggaaagtctggcccataacctgcatctgtccctgtcctcctgtccgctgtcctatgttggtgtttctgaggcttgttgccatttatagctctttgtcttcattccatgttgattcaaactgtactggcctctcttttttgctgtcgtccgtggaaataatggtgtggcagccatgcagcatgaacggggggctgcagagtgccctccagctgcctccgcccgctgccttccatgctgagttggctcgagctctatggcaggtgctaatgcatgatctgtcttcacatctccaggtggacataggctgcacttatctgggacctcatcttgctatttcttgcctgtcttgtgtttataatcttgctatttcttgcctgtcttgtgtttataattgttgctaattaaactaatcagctggttgaaattatcaggttaacatttatgtattaacagtggtttgggcaaccctctccattcgttgagccctgtagttgattatggagatcagcatattcctgcctccaagaggtgtttgtttgtttgtttgttttttcttgttttttgtttgtttgtttgttttgtttttttgagacggactcttgctctgtcacccaggctggaatacaatggcatgatctctgctcactgcaacctccgcctcctgggttcaagcaattctccttcctcagcctcccgagtagctgggaccacaggcgcataccactataccaggctaatttttgtattttttagtagagactgggttttaccatgttggccaggctggtcttgaaatactgacctcagatgatccgcccatctcagcctcccaaagtgctgggattacaggcgtgcccggcctgcctgcaggagttctttgggcccacagtctaaggcaaacacataccctgggcctgagagacagcagtcaaacaccttacaggatacagcccgcagcctccagtgctttccaggctcctgcagagttctgccatcgggcatggcttcgtgatggccttggtaagtgtgaggagagtggtttggggctggaatgaaaggccgtgaatctggaaacacactggaaccgatcaacgctatcagccctcatggtcgctgaagggcgttggttgctcctgggcaccgctgcttcagtttctgcagtggctctttcagctgttgtaattctgtgcctaggctgttgacaacttttgctgagttggacagaataagactgtgggccatgctgcttgcttcactctctgggtgtgatggatcggtgagggtgcagttgctatgattgtaattggtcatctcatcatggctgttaacatttctggaccaaacaaaaatgacttcagctacttccagattctgctgatacattacacaggatgatctaaaaggctacagttctgaagatactcatctttcttgtaatctgggggcatctggtcaatagtattgcctctgtgctgtattgtgtctagaacattcaaggacatttgatacttctcatactttaattgcgtgctctcccagttgcagcaccctctgaggcttctatgtgttgcagccgatgggcatttgcacagagcagcagtcatgacagcgttttcagggcagctatttctccttttcccccttttcctctcccccggcttcccattctcctcctcctccttcctcttctcgtcccctcctcctcctctttgttctcctccccctgctcttcttcctctctccttttcctccttctgtgtctatactagattattttcaatcagtcacatgtttttctttattttgaatgttacaaaatatttctctattgtaaacggtgtgccaggaaaaacatgagatgtgtatttgtattttttatgcacataattacttaatccaatgcctctccacttaattgggcctgatgatttttatctcgacatctgcaatactgatgatatactggaatctctaccaatttatttttggtggtaagaaagcagtcagagaacgttttgctggttatttcattccgtgtgagttcccaaccaagactgtcagcccagtgtggttcagccatatctaacctatagaggccatagaagcagttcagcttaggctggaggccagcaggctgagtgtgcgagctgacccgatggtcatttgttagggttggggggtgaactggctaacttattaactagcttatcatattaataaaaactctttaatacaaatccttgtcctgacactctgtagctttaataatcctattaccaatctggtaataaatgtgaattctgacacattgttgatgctactggttttagtaacataatgaacatcataataaagaatattcaagagtc

SEQ ID NO: 17877 - DNA, 1235 bp, Homo sapiens
atcccgctcgctccacgctgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctgggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtaaggattagaagcaatacattgtcactctaatgtaataatttaagagactcttggatacgttcacgattttcttctatactataaaatgagcttcactgcacaccttcatgacttctgagaaatgtttttaccatcagcaatgccactaacggtgttgctgtctgtgtctggtttcactggggctgcaaaggctgctggaaagtctggcccataacctgcatctgtccctgtcctc

SEQ ID NO: 17878 - DNA, 3360 bp, Homo sapiens
ggaagtgacgttaggggaaggtgggggcaatcatggtgccgctggggaggggagaagctgctgctgccgccgttgccgggagccgcggagacaagtcattacgttttcatttctcacaactgggctgagcacaactgaaccatgggggaacacagtccagacaacaacatcatctactttgaggcagaggaagatgagctgacccccgatgataaaatgctcaggtttgtggataaaaacggactggtgccttcctcatctggaactgtttatgataggaccactgttcttattgagcaggaccctggcactttggaggatgaagatgacgacggacagtgcggagaacacttgccttttctagtagggggtgaagagggctttcacctgatagatcatgaagcaatgtcccagggttatgtgcagcacattatctcaccagatcagattcatttgacaataaaccctggttccacacccatgccaagaaatattgaaggtgcaaccctcactctgcagtcggaatgtccggaaacaaaacgtaaagaagtaaagcggtaccaatgtacctttgagggctgtccccgcacctacagcacagcaggcaacctgcgaacccaccagaagactcaccgaggagagtacacctttgtctgtaatcaggagggctgtggcaaagccttccttacctcttacagcctcaggatccacgtgcgagtgcacacgaaggagaagccatttgagtgtgacgtgcagggctgtgagaaggcattcaacacactgtacaggctgaaagcacatcagaggcttcacacagggaaaacgtttaactgtgaatctgaaggctgcagcaaatacttcaccacactcagtgatctgaggaagcacattcgaactcatacaggggaaaagccatttcggtgcgatcacgatggctgtggaaaagcatttgcagcaagccaccaccttaaaactcacgttcgtacacatactggtgaaagacccttcttctgccccagtaatggctgtgagaaaacattcagcactcaatacagtctcaaaagtcacatgaaaggtcatgataacaaaggacactcatacaatgcacttccacaacacaatggatcagaggatacaaatcactcactttgtctaagtgacttgagccttctgtccacagattctgaattgcgagaaaattccagtacgacccagggccaggacctcagcacaatttcaccagcaatcatctttgaatcaatgttccagaattcagatgatacggcaattcaggaagatcctcaacagacagcttccttgactgaaagttttaatggtgatgcagagtcagtcagtgatgttccgccatccacaggaaattcagcatctttatctcttccacttgtactgcaacctggcctctccgagccaccccagcctctactacctgcctcagctccgtctgctcctccgcctgctccctccctaggacctggctcccagcaagctgcatttggcaacccccctgctctcttacaacctccagaagtgcctgttccccacagcacacagtttgctgctaatcatcaagagtttcttccgcacccccaggcaccgcagcccattgtaccaggactttctgttgttgctggggcttctgcatcagcagcggcagtggcatcagctgtggcagcaccagccccaccacaaagtactactgagcccctgccagccatggtccagactctgcccctgggtgccaactctgtcctaactaataatcccacaataaccatcaccccaactcccaacacagctatcctgcagtccagcctagtcatgggagaacagaacttacaatggatattaaatggtgccaccagttctccacaaaaccaagaacaaattcagcaagcatctaaagttgagaaggtgttttttaccactgcagtaccagtagccagtagcccagggagctctgtccagcagattggcctcagtgttcctgtgatcatcatcaaacaagaagaggcatgtcagtgtcagtgtgcatgccgggactctgcaaaggagcgggcatccagcaggagaaagggctgctcctccccaccccctccagagccgagcccccaggctcctgatgggcccagcctgcagctcccagcgcagactttctcttcagcccctgttcccgggtcatcatcctctaccttgccctcctcctgtgagcaaagccgacaagcagagactccttcagaccctcagacagaaacattaagtgccatggatgtgtcagagtttctatccctccagagcctggacaccccgtccaatctgattcccattgaagcactactgcagggggaggaggagatgggcctcaccagcagcttctccaagtgaagggcccatgtgtgctcacctctgggaaaagcgggtgagcaggaggcatgaggtacaatgcctgccatcatgggtcagaaatttgaaggatgaagaaatctactgtttgaaatcctcacctttcagacgtattttctttattcacatcccaggagcatccattttaaggaactattctttggaaaaaaacaaaaaacaaaaaaaacaacaaaaaaagctaagttataagtgaactgtttggctgcactgtatgtcacttttgcttgttgtcatgtgaacttggaaactaaggttactcgtgtgcataaaaattctaaatgaaagggtgtggtttccatcaatctgatgctgcccatcgcttgcactggggtctttgtggatcgggcaggagttttcagtgtgttgggtgttgctccttcctatgtgtcttttgaatctgaggctgacatttgcttggaaggccagacccttgctccatcagagagggcagtggcaaaggccagtgaggcagctgtgagttggacagggttcaggtgagatggtgttgtcatttgtgcttagtgttggtggtgctcagggtggataacacgggtcgttctgcagcccgcttcagcacaaataggcagcttaaggcctggctcacaggctgtggggttgatctggctctgcagaggccctaggcagcttgttgactgctgtctgttgatgacgtgtgtgcaaagcaggctctagcaacatgatcactgtccttgccttcctggttctttctctcggttggttgccagggcttgcagatcgcagtgaattttccttggggaacatcgctgttttgtcctagagtgaacttgtggcttatggccagtgctgtttggtggtctgccttctttttaatggtattttcttcctcagagcagaagggctgcattttgcttatcagaagaaggtgcagatttaagg

SEQ ID NO: 17879 - DNA, 600 bp, Homo sapiens
aaacaaagccaggtaaagcggtaccaatgtacctttgagggctgtccccgcacctacagcacagcaggcaacctgcgaacccaccagaagactcaccgaggagagtacacctttgtctgtaatcaggagggctgtggcaaagccttccttacctcttacagcctcaggatccacgtgcgagtgcacacgaaggagaagccatttgagtgtgacgtgcagggctgtgagaaggcattcaacacactgtacaggctgaaagcacatcagaggcttcacacagggaaaacgtttaactgtgaatctgaaggctgcagcaaatacttcaccacactcagtgatctgaggaagcacattcgaactcatacaggggaaaagccatttcggtgcgatcacgatggctgtggaaaagcatttgcagcaagccaccaccttaaaactcacgttcgtacacatactggtgaaagacccttcttctgccccagtaatggctgtgagaaaacattcagcactcaatacagtctcaaaagtcacatgaaaggtcatgataacaaaggacactcatacaatgcacttccacaacacaatggatcagagtctact

SEQ ID NO: 17880 - DNA, 2994 bp, Homo sapiens
atacggagcaaggcatgtttgaagagtacccgggtttggtagagtgacttctattcactaaaaccatgtgtctgaactgaagaagcttgggctcacttccacaaatgtggaaaaatgctaatcactgaaagaaaacattttcggtcaggaagaattgcacaaagtatgtctgaagcaaatttgattgacatggaagctggaaaactctcaaaaagttgcaatattacagaatgccaggacccagacttgcttcacaattggccggatgctttcacccttcgtggtaataatgcttccaaagttgcaaatccattctggaatcaactgtctgcttctaacccatttttggatgacataactcaactaagaaataacaggaagagaaataatatttccatcttaaaggaagatccttttcttttctgtagagaaatagaaaatggaaattcttttgattcctccggtgatgaacttgatgtgcatcagttacttaggcagacttcctcaagaaattctggaagatctaaaagtgtttcagaacttctggacattttagacgacacagcacatgcccatcagagtatacataactctgaccagatcctactacacgacttagagtggcttaaaaatgatcgggaggcttataaaatggcttggttaagtcaacgccagctggcccgctcctgccttgatttgaatacaattagtcagagccctggatgggcccagacacaacttgcggaggtcaccatagcttgcaaagtaaaccatcaaggagggtcagtacaattacctgaatcagacatcactgttcatgtgccccaaggtcatgtggctgtgggagaattccaagaggtgtctctaagggctttccttgatccgccacacatgcttaaccatgatctttcgtgcactgtgagcccgttgttggaaatcatgttaggcaacctcaatacaatggaagcccttttgctggagatgaaaattggggctgaagtaagaaaggatcctttcagccaagtcatgacagaaatggtgtgtttacacagcttgggtaaagaaggcccttttaaagttttaagcaactgctacatttataaagacaccatccaagtcaagctaatcgacttgagtcaggtaatgtatctagtggttgctgcacaagctaaagctcttccgtcaccagctgccaccatttgggattatatccacaaaaccacctcaattggaatttatggacccaaatatatccatcccagttttactgttgttttaacagtttgtggacacaattatatgccaggacagcttacaatttctgatattaagaagggtggaaaaaacatatctccagttgtgtttcagctctgggggaagcagtcatttttacttgacaagccacaagatttaagtatttctattttttcctgtgatcctgattttgaagtaaagacagaaggagaaaggaaagaaattaaacaaaagcagttggaagcaggtgaagtagttcatcaacaatttttattttctttagttgagcacagagagatgcacttgtttgatttttgtgttcaagtggagcctcccaatggtgaaccagttgcacagttctctatcactactcctgatccaaccccaaacctaaaaagactctcgaatctgccaggctatttgcagaagaaggaggaaatcaagtctgctcctttatcaccaaaaattcttgttaaatatcctacatttcaagataaaacattgaactttagcaactatggggtaaccctgaaggcagtgctaagacaaagcaagattgattacttccttgaatatttcaaaggggacacaatagctctcctcggggaaggtaaggtaaaagctattggtcagtccaaagtgaaagaatggtatgtaggagtcctcagaggtaagattggacttgtacactgcaaaaatgtcaaggtgatttcaaaggagcaagtaatgtttatgtcagatagtgtctttacaaccagaaatcttcttgaacagattgtcctgcctttaaaaaaattgacttatatctactcagttgtattaaccttggtgtcagaaaaagtttatgattggaaagttttagctgatgtcctgggttactcacatctgtccctggaagattttgatcaaattcaagcagacaaagaatcagagaaagtttcttatgttataaagaagttaaaggaagattgccacacagagagaaatacaaggaagtttctgtatgaacttattgtggctcttctgaaaatggattgccaagagttagtcgcacgtctcatccaagaagctgctgttctgacttcagctgtcaagcttggaaaaggctggagggaactagctgaaaagttagtacgactcacaaagcaacaaatggaggcatatgaaattcctcatcgaggaaacactggagatgttgctgttgagatgatgtggaaacctgcctatgattttctgtatacctggagtgctcactatggaaataactacagagatgtgttacaagaccttcagtcagctttggacagaatgaaaaaccctgtgactaaacactggagagaattaactggagttttaatactagtaaattctttggaggttttgagagtaactgcattctccacttctgaggaagtatagaaacaaagcgtgtgtttttgatgggagggaaaatgaggtaatggtgtgtgtgtgtgtgtgtctgtgtgtgtctgtgtgtgtctctgtgtgtctgtgtgtgtgtgtctgtgtgtgtgtgtctgtgtgtgtgtgtgtgtgtgtgtaggaaagaaagaatctcagaaaagcattatattaattttcttcatgctcaaaaccagtttttttttcctgatgaaagcacagcctaactgataaccaagatgggttttatcctcaaatatgtatttttgtgtatgtttcaaatacaagtattaggctgctttgttcttagaaaggaaa

SEQ ID NO: 17881 - DNA, 7417 bp, Homo sapiens
atgtttgaagagtacccgggtttggtagagtgacttctattcactaaaaccatgtgtctgaactgaagaagcttgggctcacttccacaaatgtagccttgtcagatgatatgcaaatgattcacatcagtgtttgaagttcaaaccaaggaaaactatcagaaaaggcttctgctttctttaaaaaataaaactacttgaaaagaaaaaaatcaagaattagaaagaagagtataacaataaagaaggaggggtcacaggtgaacgagatgtggtcaacacacacaaaggagaacaaaaagtggaaaaatgctaatcactgaaagaaaacattttcggtcaggaagaattgcacaaagtatgtctgaagcaaatttgattgacatggaagctggaaaactctcaaaaagttgcaatattacagaatgccaggacccagacttgcttcacaattggccggatgctttcacccttcgtggtaataatgcttccaaagttgcaaatccattctggaatcaactgtctgcttctaacccatttttggatgacataactcaactaagaaataacaggaagagaaataatatttccatcttaaaggaagatccttttcttttctgtagagaaatagaaaatggaaattcttttgattcctccggtgatgaacttgatgtgcatcagttacttaggcagacttcctcaagaaattctggaagatctaaaagtgtttcagaacttctggacattttagacgacacagcacatgcccatcagagtatacataactctgaccagatcctactacacgacttagagtggcttaaaaatgatcgggaggcttataaaatggcttggttaagtcaacgccagctggcccgctcctgccttgatttgaatacaattagtcagagccctggatgggcccagacacaacttgcggaggtcaccatagcttgcaaagtaaaccatcaaggagggtcagtacaattacctgaatcagacatcactgttcatgtgccccaaggtcatgtggctgtgggagaattccaagaggtgtctctaagggctttccttgatccgccacacatgcttaaccatgatctttcgtgcactgtgagcccgttgttggaaatcatgttaggcaacctcaatacaatggaagcccttttgctggagatgaaaattggggctgaagtaagaaaggatcctttcagccaagtcatgacagaaatggtgtgtttacacagcttgggtaaagaaggcccttttaaagttttaagcaactgctacatttataaagacaccatccaagtcaagctaatcgacttgagtcaggtaatgtatctagtggttgctgcacaagctaaagctcttccgtcaccagctgccaccatttgggattatatccacaaaaccacctcaattggaatttatggacccaaatatatccatcccagttttactgttgttttaacagtttgtggacacaattatatgccaggacagcttacaatttctgatattaagaagggtggaaaaaacatatctccagttgtgtttcagctctgggggaagcagtcatttttacttgacaagccacaagatttaagtatttctattttttcctgtgatcctgattttgaagtaaagacagaaggagaaaggaaagaaattaaacaaaagcagttggaagcaggtgaagtagttcatcaacaatttttattttctttagttgagcacagagagatgcacttgtttgatttttgtgttcaagtggagcctcccaatggtgaaccagttgcacagttctctatcactactcctgatccaaccccaaacctaaaaagactctcgaatctgccaggctatttgcagaagaaggaggaaatcaagtctgctcctttatcaccaaaaattcttgttaaatatcctacatttcaagataaaacattgaactttagcaactatggggtaaccctgaaggcagtgctaagacaaagcaagattgattacttccttgaatatttcaaaggggacacaatagctctcctcggggaaggtaaggtaaaagctattggtcagtccaaagtgaaagaatggtatgtaggagtcctcagaggtaagattggacttgtacactgcaaaaatgtcaaggtgatttcaaaggagcaagtaatgtttatgtcagatagtgtctttacaaccagaaatcttcttgaacagattgtcctgcctttaaaaaaattgacttatatctactcagttgtattaaccttggtgtcagaaaaagtttatgattggaaagttttagctgatgtcctgggttactcacatctgtccctggaagattttgatcaaattcaagcagacaaagaatcagagaaagtttcttatgttataaagaagttaaaggaagattgccacacagagagaaatacaaggaagtttctgtatgaacttattgtggctcttctgaaaatggattgccaagagttagtcgcacgtctcatccaagaagctgctgttctgacttcagctgtcaagcttggaaaaggctggagggaactagctgaaaagttagtacgactcacaaagcaacaaatggaggcatatgaaattcctcatcgaggaaacactggagatgttgctgttgagatgatgtggaaacctgcctatgattttctgtatacctggagtgctcactatggaaataactacagagatgtgttacaagaccttcagtcagctttggacagaatgaaaaaccctgtgactaaacactggagagaattaactggagttttaatactagtaaattctttggaggttttgagagtaactgcattctccacttctgaggaagtatagaaacaaagcgtgtgtttttgatgggagggaaaatgaggtaatggtgtgtgtgtgtgtgtgtctgtgtgtgtctgtgtgtgtctctgtgtgtctgtgtgtgtgtgtctgtgtgtgtgtgtctgtgtgtgtgtgtgtgtgtgtgtaggaaagaaagaatctcagaaaagcattatattaattttcttcatgctcaaaaccagtttttttttcctgatgaaagcacagcctaactgataaccaagatgggttttatcctcaaatatgtatttttgtgtatgtttcaaatacaagtattaggctgctttgttcttagaaaggaaagaaaaaagaaaagtgccctctctctctttcagtgttattttaaatttactaagtcaaagctgtttgaataattacatcacacagatatctgggtaaactagagactatcaacatgatcaaggcagtgttcccaggaggcagctagaaagaggggaagcaagcacacaccctgtggccagtcacggctgcccgctttccacacctgacctcttcagttcatcagtggggttcaccagcatcacccccatttttcatggggagaaactcagaagtggagagaacgtctgaggctacatagccagtacaaagtaggttttctgcttgaaaaacctgtttctatttctttttaaaaaatcatactgcataacagaatagtaaaaacaaaatgcgtgttaagacttacagggaaacagttgccgtttcattttaagtgagacttgctactctttttcatcgtctcttgaaagactgacagaaggaaaatatgacttatcagaaatctgttgtctgcatgcatggacctagtgttttcatcagctcccttcagcatcttgggacctctctaatcctgcctaatttgggactttttctgcaggattgtaatgtaaaatagttctttagctcttggagatttttaataatacgagttattaaaaaccaccaccaccagaaacttgattaacttgattaccctgttgagtagagaggtcttaaccaccgaaaacactgatatctttatgttggcatgctcatgcaaacacatgtgtgtgtgtgtgtgtgtgtgtgtgtgtgtgtgtgtaccacagtgttttataaagcacagcctaattgattatataggacaaaaattgtataggaccctgggtcagtataaatgctaatggctgacaaagttcacaaagagatgtattttgcttactcctctgttcaatcctctggttgcctgccagtgtttatgtgtgtatttggacagacattcatttattgtcattcagtcaataggtagagtatatgtgtctattttttggcaggcatatagatgcttgaggctaatgggaaaaaaccagcatgaactctgactttagtagtgctaagtaatagataattttaaaaaatgacaccgttaaatagaaaatggcatgcatactaacagttgcaatggagaggctgtgatgctacgagatataaacgtagagatgccatcatgtgaaactggaagtgggggtgggtcagggaaatttgttcttggaaagaaataatgaacctcaaggaagagtaggcattgtcctggtgtggtggggtgtaagcggtgatcccacaaagcactgaagctcttagatgggtgggagctgaataggtgcagatagcaggggtgaaggagtgaaaggataaaagattcaaggttgagatgaggatggagcaagaagaagccacattagggccattaaggctgctagaatttagaaagaaaacacacagcctcaaagaaatgtgggtaagccaaagaaggattttgttttgggaacctgaataaaagatgtccatttggctaaaaagtaaaagcagaatctttttagggcttttaatatacccaccctgggatatttggtatgctggcaatggtaattcaaattggcgtttaagaataatcttggccgggcgcgatggctcatgcctgaaatcccagcactttgggaggccgaggcgggcagatcactaggtcaggagatcgagaccatcctggctaacgcggtgaaaccccgtctctactaaaaatacaaaaaattagccgggcgtggtggcaggcgcctgtagtcccagctactcaggaggctgaggcaggagaatggcgtgaacccgggaggcggagcttgcagtgagccgagttcatgccactgcactccagcctgggtgacaggctgtctcaaaaaaaaaaaaaggaataatctgtacggctttcagtatttatatttgattataagggaacacagcctgaccaaataattatgtatacacattcaaggacagaatttattttaattaaaaataaattatgagagaaggaaaaaaaagcacagtttttactttcagaacacagtccttttttgtggtgattttgctttctttagaacattcttggaatcttattaacatgtcagctaaccagagaattttgggaagggatagtggggattaataactgggtttttccaggctccaagatctaagaagacagagatcttgttagctgattagtgtagtaagattaaataaataatttaaggtttacattgcatcatgtattatgattgtgattgagaataataagagtttaaaaaaatgaaaaacaagatctctgtaatttgaggatgaaacaatggttctaatattaatacacacaaatatattttataatcttgtaacaaatccttccaggggaaattttttttttttttttttttttttttttttgagccagagtctggctctgttgcccagactggagtgcggtgtttcaatcttgactcactgcaacctccacctcctgggttcaaaagatccttctgcctccgcctcccaagtagctgggattacaggcatgcaccaccttgtccgggtaatttttgtatttttagtggagacaaggttttaccattttggccagactggtctggaactcctgacctcaggtcatccacctgcctcggcctcccagagtgctaggattacaggcatgagccactgctcccagccttccagaggaattttaagcccatgtccaaacattctgtttgtataaatatattctaatttttaaataaatagtttctacttttctgaactttatattttttcttgctataatggattttcataatcagaaaagattaaattagtaatcatgaattgccttcaatatttggcagtaagtcaatgaaataataaggcacttatataccatctttgacatcattaaaagtatcaaatcccattaatctaaaacttctttaagcattttgaaagcagaaaatgtttacatggttctttcagttcctcaggctttttgtctaatgatgcgtgacttaggataagatttgaattaagtgcccagcttgaaacataataatttttctgtataagccacagatcctctacctcctttgtgttaaagcctttatatgaaacaattaagtagaagcattcaatagtgtgtcattaactgttcatactaataaatggatacagcacattttcatggcctgtaatgtagaacatactatataaagttctcagtttggggatgactaggtttctggaaggaatagaatgctaaatcaatggatggcattgggctgagaaacactgctgctactaatcagccttgaatgtgtaatgtgaacatgcaaaagagaacatgcatacactcaaatttgtacaatgctataactggaagttgaaggacttgaatttttatattgtgctattgttatgttttctgtaattgtttatatctaaggaatttttgaggtaatataaaagaaaaagagaataatgaacaatgatgtcactggagggtttttacattaaattagatcatttttcttcttattcacaataataatcttaatctttaagaattaattataatttaatattataattcataatctttaagaattaataattataatttaatattataattaataatctttaagaattaataatataatttaatattataattaataatctttaagaattaataattacaattaataattaataataatcttaatctttaagaattaataataatccttaatcgcaataataatcgcaaggaggagaagtaagtccctcctccttctgtatgaacttttctcccacatgctgctgtatggtttagtgagagtgaagttctaaagaacatcaatatgattggtgggataatccaaagacattttttcagaatcaaatggcatgtcgaaggtttgtttcttgcatatgtatttactggtccacagcacaaaataaagtgaccacatatacataggaaagttgaatttgtacacatacagcatctgaaatgtatctgatgttcagcatcaagatttcactgaacattgtagaaatgtgtatcttttgcatgtatattttacattgattttctatttatgtacatctagaaagttttaaccctaataaatagttttgtaattttgaa

SEQ ID NO: 17882 - DNA, 1441 bp, Homo sapiens
tggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgacactccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagaggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactga

SEQ ID NO: 17883 - DNA, 1632 bp, Homo sapiens
aagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgacactccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactga

SEQ ID NO: 17884 - DNA, 946 bp, Homo sapiens
agagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggtacccagtatcccttgggggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggc

SEQ ID NO: 17885 - DNA, 1654 bp, Homo sapiens
aaagacaagcctgttgggttgaaagaagaagaagaagaagaaaaaaaaactcaggcaaagtcacagcctcaaaattgttcactgaaagaagcgtgagtggagaagtgtgagaagatgaatggaccggtggatggcttgtgtgaccactctctaagtgaaggagtcttcatgttcacatcggagtctgtgggagagggacacccggataagatctgtgaccagatcagtgatgcagtgctggatgcccatctcaagcaagaccccaatgccaaggtggcctgtgagacagtgtgcaagaccggcatggtgctgctgtgtggtgagatcacctcaatggccatggtggactaccagcgggtggtgagggacaccatcaagcacatcggctacgatgactcagccaagggctttgacttcaagacttgcaacgtgctggtggctttggagcagcaatccccagatattgcccagtgcgtccatctggacagaaatgaggaggatgtgggggcaggagatcagggtttgatgttcggctatgctaccgacgagacagaggagtgcatgcccctcaccatcatccttgctcacaagctcaacgcccggatggcagacctcaggcgctccggcctcctcccctggctgcggcctgactctaagactcaggtgacagttcagtacatgcaggacaatggcgcagtcatccctgtgcgcatccacaccatcgtcatctctgtgcagcacaacgaagacatcacgctggaggagatgcgcagggccctgaaggagcaagtcatcagggccgtggtgccggccaagtacctggacgaagacaccgtctaccacctgcagcccagtgggcggtttgtcatcggaggtccccagggggatgcgggtgtcactggccgtaagattattgtggacacctatggcggctggggggctcatggtggtggggccttctctgggaaggactacaccaaggtagaccgctcagctgcatatgctgcccgctgggtggccaagtctctggtgaaagcagggctctgccggagagtgcttgtccaggtttcctatgccattggtgtggccgagccgctgtccatttccatcttcacctacggaacctctcagaagacagagcgagagctgctggatgtggtgcataagaacttcgacctccggccgggcgtcattgtcagggatttggacttgaagaagcccatctaccagaagacagcatgctacggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaggttactggaaattaggggattaacccac

SEQ ID NO: 17886 - DNA, 3410 bp, Homo sapiens
atataggagtcgctcaggagcaagctgtggcaagctggagggagggacacatcccgtgttccatccactccctcccttctcagcagtcctcgcctgttctcacgtgctcacaggcagttaggcagaagtgatccccgtggctctgccaaagacaagcctgttgggttgaaagaagaagaagaagaagaaaaaaaaactcaggcaaagtcacagcctcaaaattgttcactgaaagaagcgtgagtggagaagtgtgagaagatgaatggaccggtggatggcttgtgtgaccactctctaagtgaaggagtcttcatgttcacatcggagtctgtgggagagggacacccggataagatctgtgaccagatcagtgatgcagtgctggatgcccatctcaagcaagaccccaatgccaaggtggcctgtgagacagtgtgcaagaccggcatggtgctgctgtgtggtgagatcacctcaatggccatggtggactaccagcgggtggtgagggacaccatcaagcacatcggctacgatgactcagccaagggctttgacttcaagacttgcaacgtgctggtggctttggagcagcaatccccagatattgcccagtgcgtccatctggacagaaatgaggaggatgtgggggcaggagatcagggtttgatgttcggctatgctaccgacgagacagaggagtgcatgcccctcaccatcatccttgctcacaagctcaacgcccggatggcagacctcaggcgctccggcctcctcccctggctgcggcctgactctaagactcaggtgacagttcagtacatgcaggacaatggcgcagtcatccctgtgcgcatccacaccatcgtcatctctgtgcagcacaacgaagacatcacgctggaggagatgcgcagggccctgaaggagcaagtcatcagggccgtggtgccggccaagtacctggacgaagacaccgtctaccacctgcagcccagtgggcggtttgtcatcggaggtccccagggggatgcgggtgtcactggccgtaagattattgtggacacctatggcggctggggggctcatggtggtggggccttctctgggaaggactacaccaaggtagaccgctcagctgcatatgctgcccgctgggtggccaagtctctggtgaaagcagggctctgccggagagtgcttgtccaggtttcctatgccattggtgtggccgagccgctgtccatttccatcttcacctacggaacctctcagaagacagagcgagagctgctggatgtggtgcataagaacttcgacctccggccgggcgtcattgtcagggatttggacttgaagaagcccatctaccagaagacagcatgctacggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaccagctccccctccctccccttgcctgtgccaggtgaggtcagcacatctcaacaggcctcagggctccttgtgggcctgggctcctggacccccctttcacaggcagccagtgccctgagccagggtctccagaaagccccacccaggccaggcatgtggcaggggttagagcaggactgatgtctcctaagcacctgtaatgtgcgagggacccagctaataactgatctcgttttttcttcactgcaacatgatgaggtagtaccttttatatcccatttatagatgggggaaagcaaagcacagagagtctggataacttccacagggtcccacagccacgtgtttagacctagatgtataactaggagctttgactcaggagcctgtgacataccccctcccccaccgttgtctcatgccagtaacaggctcaaacaatgacaaagcagattcagaaatgaggccatggactctgtcctgaaggcctgaggttactggaaattaggggattaacccactagctcttgttgagccgtgggcaattgtctgaaaagtgaagacagaaccacagggctattttgtttgcttcatgtgtcccagaagatgactgagggtgagttggcttacctggcccatcagggtaggctggagttagggactgaccagcagctttagaatcccagccccctgaccactcagagacatgcagagattgggtttttggacttctggggtaagtggtctaagtccagtccagtcctatctgggcttcctggagcagaagcagcaacttgtcctagcacagatggccagccccttagacagaggccctcaagtctttctctttccctggtcccttgtatcccctgcaggctgagtgcatttggagggagtgagtggccctttcggatccagggaggctggtcctatggcctcatgttaaataggcggggcttgccttctggtgttggacaagcttctgagacgtcatgaggagattctgcctttgccaggtgactgtctggggagcgggtctgctcccaaggggcctgagcagtccttggcctgctaaggtcttggaacttgcctgcctttccatccatggccagcagcacctgccctacctgccccacttgtccttagcctggacctctgacagcagcatctctaccttctccccagctcccaggaccacaggctcaggcaggggcctccatgggccccaggggaacactggggacttggcctctctctagggtacatggtgctgggagaggcagcccaggaagtctcatctggggagcaggcagccagcatctgggccttggcctggagcacaaagaccctggctttcattttctctcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaacta

SEQ ID NO: 17887 - DNA, 435 bp, Homo sapiens
gagtctgtgggagagggacacccggataagatctgtgaccagatcagtgatgcagtgctggatgcccatctcaagcaagaccccaatgccaaggtggcctgtggctttgacttcaagacttgcaacgtgctggtggctttggagcagcaatccccagatattgcccagtgcgtccatctggacagaaatgaggaggatgtgggggcaggagatcagggtttgatgttcggctatgctaccgacgagacagaggagtgcatgcccctcaccatcatccttgctcacaagctcaacgcccggatggcagacctcaggcgctccggcctcctcccctggctgcggcctgactctaagactcaggtgacagttcagtacatgcaggacaatggcgcagtcatccctgtgcgcatccacaccatcgtcatctctgtgcag

SEQ ID NO: 17888 - DNA, 2819 bp, Homo sapiens
ttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaa

SEQ ID NO: 17889 - DNA, 2144 bp, Homo sapiens
cgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctt

SEQ ID NO: 17890 - DNA, 1803 bp, Homo sapiens
cgactagcgcaggcggacgggagagaatgggggaggggtgggatgggagcaggggcagagacgggcagagggcagagggcggagcggcgccggagcgggcgtcatggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaaactgggctgaatttgctgctgtctccagcgagtcattgcttctcttaatttatttacctggaatcaacttaatcctgtgtgttaggctgttcttgtgttgctataaagaagtacctgatcaggatctgggagaatttgaaaaaaaaagaaaaactagaaaaataaacaaaattaaaaagaaaaaaaaatacctgagactgagtaacttataaagaaaagaggtttaattgactcacagttctgcagggtgtacagaaagcatggtgccagcatttgctcggattctggggagacctgagggagcttttactcatggcagaaggtgaagggggagccggcgtctcacatggcaaagcaggagcaagagagagtggtagggaggtgccacatacttttaaacagccagatctctcaagaactcactcactgtcaccaggacagcaccaagccatgagggatccaccctcatgacccagttacctcccggcagggcccacctccggcactaggaattatacttcaacataagatttggagagggaaaacatccaaaccatatcacccaactcccacttggagtagaacttcacaaaacgacagagggacagctgtttccatcaaacacttccacagcttcacctgagacgagggcatgactctgggaacatcaggaggctgatggactattaagccaaacaattcctacaaaaattccctgcaccttccactgcgtttcagtccttgacagacataagtaagggatcaagtgagaagaggaaggaaaatacaggatccaaggaatcaacaatgctagcactgaagagcaggattacggaggagctgtgctctgggagcatatatggtgatcaatcagatgcatgacttttttttcaaaattttaaatgtcttgagcatgctacttccaaccattctacccacaaataaactgcaataggacttggttagatttcaatgattatgaataaatgttcaccttcataccttctggttacaaagctaaactttaaaatgtccaaataaaatattcactaaaattta

SEQ ID NO: 17891 - DNA, 4417 bp, Homo sapiens
atatttggactcggctgcccgtgcccaggaatttcccgtcatgcctcccgccgccccgtccgtcgcccggagccggggagggagggagcgaggttcggacaccggcggcggctgcctggcctttccatgagcccgcggcggaccctcccgcgccccctctcgctctgcctctccctctgcctctgcctctgcctggccgcggctctgggaagtgcgcagtccgctcttgcccctgttctttgcttctcgttttgttggtgaagatatcacagtgatgtctgcattcaacctgctgcatttggtgacaaagagccagccagtagcccttcgagcctgtgggcttccctcagggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcagtggcaccgccgagggaggcagtggggtcgccagcccggcccaggcagacaaagcggagctctagagtaatggagagtgatggaaacaaagtgtacttaatgcacagcttattaaaaaaatcaaaattgttatcttaatagatatattttttcaaaaactataagggcagttttgtgctattgatattttttcttcttttgcttaaacagaagccctggccatccatgtattttgcaattgactagatcaagaactgtttatagctttagcaaatggagacagctttgtgaaacttcttcacaagccacttataccctttggcattcttttctttgagcacatggcttcttttgcagtttttccccctttgattcagaagcagagggttcatggtcttcaaacatgaaaatagagatctcctctgcagtgtagagaccagagctgggcagtgcagggcatggagacctgcaagacacatggccttgaggcctttgcacagacccacctaagataaggttggagtgatgttttaatgagactgttcagctttgtggaaagtttgagctaaggtcatttttttttttctcactgaaagggtgtgaaggtctaaagtctttccttatgttaaattgttgccagatccaaaggggcatactgagtgttgtggcagagaagtaaacattaccacactgttaggcctttattttattttattttccatcgaaagcattggaggcccagtgcaatggctcacgcctgtgatcccagcactttgggaggccaaggcgggtggatcacgaggtcaggagatggagaccatcctggctaacatggtgaaaccccgtctctactaaaaatacgaaaaattagccaggcgtggtggtgggcacctgtagtcccagctactcaggaggctgaggcaggagaatggcgtgaacccggaaggcggagcttgcagttagccgagatcatgccactgcactccagcctacatgacaatgtgacactccatctcaaaaaataataataataacaatataagaactagctgggcatggtggcgcatgcatgtagtcccagctactcctgaggctcagtcaggagaatcgcttgaacttgggaggcggaggttgcagtgagctgagctcataccactgcactccagcctgaacagagtgagatcctgtcaaaaaagaaaagaaaaagaaagcagcattcaaatgtaagacaactgtaaaatattgagccccacttggtctaaaattcaaaaagaagaacgcctgtccatcgcctttttataagtccttctctccacacctaaaagcagctgcagctggaagggcacaaattccactgtgtaaaataaaatattaggggcaacacacttcatcaaggcagcaggaatgagagagagcagagaagatcaaggatgaagtcttgggtactgaaaaattcagtgctgggcagaaaaactgacagggcagtacaagtaacaaacagaatccaagtggggtggcccttgtgcacagagctccaggtgacctctggagagacatgggcattcacatggaaagctaaaacggaagctcaagtttcatactcaacataatcttctgtgtgacaaaggacaagccatgtagcctctctgtgcctatttcttcatgcataaactgggactcataatatttgtaaaatgtattgatactctcagggcaaattcactatattgctatacagttgagatcagtgttgtaaaattaaactgatctggttctaattgcctcaaaggccaaagcccaggcatttgaaatggaaagaagcagagaggaggctgacttagctgattggtatggaaacagttgggccaagagccagaatttccctttgtagcaacacggctagttttactttgagaagctctgctcagctgctttataacattaagtctggcggaatggatgtcactgtgcacaataaagttttcacaagtataaacaatggtgatgtaagtcaacattgctgtagccaggtgtgaaggttgtatggtgtgtgacgaatgtacatcatgtttgtaggtttggatgctaatcttgaattgtagtttaaaaaatacgtatttttgtaactctttgaaagtttatgaagactgacagctttccttgtaagcactaagagaaaaaaaagaaagagggacatttgacaattttaaagaaacaacaagaaattagaatgaaaatctgtgacaaacagcgtcagtgtggccatgtccacattcctacatgtctctctctacaagcacctctctaagaagcctgacatcccggtggactctttatagtcatgtacacttgattccagatgagctctggtcttatctggatgctcagataagaggtttctatctgagcatccagatgttccctcaggttccaagacatttcaccccaggccctgggttcactctggaattcgtaggcttcacgtctctctagaaatgacgtgtaaaatttaagaccagacctcagccatcagcgtccagaccatcctagaagtctttcccaatctcacagagaaagccctagtatttcccagtgaccccaggattccacgttggggtggccaaagaaataggtctctcagggctttgccacagcctccagcccatccttcagaggcacacacagcacctctcggctgctccagctctgtaggatagcctcccctggggtccgtgggacgcgggccacagtgttgaggtagacaaggaggatcagtgagaggcctcttccctctccacagagactggattgtcattgttccttcatttatatcgtagggcttaacatttcactcaaaaaaaagcccctctttttctaatccttagtctttgtttcaaggaaagccagtttttcttctaccacattttccaggatcgactttaagaaaaatgcaacatctattgaaaaaaagtggggtgtatgcatgtggtttaattccagattgcttttgggtttaagtggtatcaaatttcagtatatttctgtcttatgtgaaagaaatatattactaaaacgtcagtgagcaataatgtcagctgtcaagcactagatttatttttgcaggatatggagtgcaatgaactgagtcaatatggcaaggtgtatgtgatctgtgggagttatgccatttaacataggaagtgcatgggactttccctctctgcactccagctcttactgtaccattagaagatgcagaattctgttggtgtgcaaaaagtatagccttacattcaagcagaatggatctgaagaaagcagcaatatctgttactagagaacattcccatgtgtttaaactcttcacttcttagatgcatttaaattcttaatgcaaatgacgtagcaatttgaaaacttctccgtattacttgtgtttaaaatgtcttgctttaaatacaaaacaaatggtaaaggggattatcttttgtttagatggttaaatattatttttgccttagatagctttgtaataatttttctccagacagttcaacacttttgaaaaatgacatgaattttcattaaaaacccttttcctatgtttattgtatacaagaattatgcaataaaatttctttataaaaata

SEQ ID NO: 17892 - DNA, 4289 bp, Homo sapiens
atatttggactcggctgcccgtgcccaggaatttcccgtcatgcctcccgccgccccgtccgtcgcccggagccggggagggagggagcgaggttcggacaccggcggcggctgcctggcctttccatgagcccgcggcggaccctcccgcgccccctctcgctctgcctctccctctgcctctgcctctgcctggccgcggctctgggaagtgcgcagtccgggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcagtggcaccgccgagggaggcagtggggtcgccagcccggcccaggcagacaaagcggagctctagagtaatggagagtgatggaaacaaagtgtacttaatgcacagcttattaaaaaaatcaaaattgttatcttaatagatatattttttcaaaaactataagggcagttttgtgctattgatattttttcttcttttgcttaaacagaagccctggccatccatgtattttgcaattgactagatcaagaactgtttatagctttagcaaatggagacagctttgtgaaacttcttcacaagccacttataccctttggcattcttttctttgagcacatggcttcttttgcagtttttccccctttgattcagaagcagagggttcatggtcttcaaacatgaaaatagagatctcctctgcagtgtagagaccagagctgggcagtgcagggcatggagacctgcaagacacatggccttgaggcctttgcacagacccacctaagataaggttggagtgatgttttaatgagactgttcagctttgtggaaagtttgagctaaggtcatttttttttttctcactgaaagggtgtgaaggtctaaagtctttccttatgttaaattgttgccagatccaaaggggcatactgagtgttgtggcagagaagtaaacattaccacactgttaggcctttattttattttattttccatcgaaagcattggaggcccagtgcaatggctcacgcctgtgatcccagcactttgggaggccaaggcgggtggatcacgaggtcaggagatggagaccatcctggctaacatggtgaaaccccgtctctactaaaaatacgaaaaattagccaggcgtggtggtgggcacctgtagtcccagctactcaggaggctgaggcaggagaatggcgtgaacccggaaggcggagcttgcagttagccgagatcatgccactgcactccagcctacatgacaatgtgacactccatctcaaaaaataataataataacaatataagaactagctgggcatggtggcgcatgcatgtagtcccagctactcctgaggctcagtcaggagaatcgcttgaacttgggaggcggaggttgcagtgagctgagctcataccactgcactccagcctgaacagagtgagatcctgtcaaaaaagaaaagaaaaagaaagcagcattcaaatgtaagacaactgtaaaatattgagccccacttggtctaaaattcaaaaagaagaacgcctgtccatcgcctttttataagtccttctctccacacctaaaagcagctgcagctggaagggcacaaattccactgtgtaaaataaaatattaggggcaacacacttcatcaaggcagcaggaatgagagagagcagagaagatcaaggatgaagtcttgggtactgaaaaattcagtgctgggcagaaaaactgacagggcagtacaagtaacaaacagaatccaagtggggtggcccttgtgcacagagctccaggtgacctctggagagacatgggcattcacatggaaagctaaaacggaagctcaagtttcatactcaacataatcttctgtgtgacaaaggacaagccatgtagcctctctgtgcctatttcttcatgcataaactgggactcataatatttgtaaaatgtattgatactctcagggcaaattcactatattgctatacagttgagatcagtgttgtaaaattaaactgatctggttctaattgcctcaaaggccaaagcccaggcatttgaaatggaaagaagcagagaggaggctgacttagctgattggtatggaaacagttgggccaagagccagaatttccctttgtagcaacacggctagttttactttgagaagctctgctcagctgctttataacattaagtctggcggaatggatgtcactgtgcacaataaagttttcacaagtataaacaatggtgatgtaagtcaacattgctgtagccaggtgtgaaggttgtatggtgtgtgacgaatgtacatcatgtttgtaggtttggatgctaatcttgaattgtagtttaaaaaatacgtatttttgtaactctttgaaagtttatgaagactgacagctttccttgtaagcactaagagaaaaaaaagaaagagggacatttgacaattttaaagaaacaacaagaaattagaatgaaaatctgtgacaaacagcgtcagtgtggccatgtccacattcctacatgtctctctctacaagcacctctctaagaagcctgacatcccggtggactctttatagtcatgtacacttgattccagatgagctctggtcttatctggatgctcagataagaggtttctatctgagcatccagatgttccctcaggttccaagacatttcaccccaggccctgggttcactctggaattcgtaggcttcacgtctctctagaaatgacgtgtaaaatttaagaccagacctcagccatcagcgtccagaccatcctagaagtctttcccaatctcacagagaaagccctagtatttcccagtgaccccaggattccacgttggggtggccaaagaaataggtctctcagggctttgccacagcctccagcccatccttcagaggcacacacagcacctctcggctgctccagctctgtaggatagcctcccctggggtccgtgggacgcgggccacagtgttgaggtagacaaggaggatcagtgagaggcctcttccctctccacagagactggattgtcattgttccttcatttatatcgtagggcttaacatttcactcaaaaaaaagcccctctttttctaatccttagtctttgtttcaaggaaagccagtttttcttctaccacattttccaggatcgactttaagaaaaatgcaacatctattgaaaaaaagtggggtgtatgcatgtggtttaattccagattgcttttgggtttaagtggtatcaaatttcagtatatttctgtcttatgtgaaagaaatatattactaaaacgtcagtgagcaataatgtcagctgtcaagcactagatttatttttgcaggatatggagtgcaatgaactgagtcaatatggcaaggtgtatgtgatctgtgggagttatgccatttaacataggaagtgcatgggactttccctctctgcactccagctcttactgtaccattagaagatgcagaattctgttggtgtgcaaaaagtatagccttacattcaagcagaatggatctgaagaaagcagcaatatctgttactagagaacattcccatgtgtttaaactcttcacttcttagatgcatttaaattcttaatgcaaatgacgtagcaatttgaaaacttctccgtattacttgtgtttaaaatgtcttgctttaaatacaaaacaaatggtaaaggggattatcttttgtttagatggttaaatattatttttgccttagatagctttgtaataatttttctccagacagttcaacacttttgaaaaatgacatgaattttcattaaaaacccttttcctatgtttattgtatacaagaattatgcaataaaatttctttataaaaat

SEQ ID NO: 17893 - DNA, 630 bp, Homo sapiens
ctgcggggacagcccctgcctcagccgagaaggggagcagaagggttgcgccccgcgccagcggtgaggggccgaacggaaggagctcttgcccctgttctttgcttctcgttttgttggtgaagatatcacagtgatgtctgcattcaacctgctgcatttggtgacaaagagccagccagtagcccttcgagcctgtgggcttccctcagggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcag

SEQ ID NO: 17894 - DNA, 964 bp, Homo sapiens
caccggcggcggctgcctggcctttccatgagcccgcggcggaccctcccgcgccccctctcgctctgcctctccctctgcctctgcctctgcctggccgcggctctgggaagtgcgcagtccgagtgacatcactgcctctcttcctgtgcgctggctttgacataagccagatggccaccgtggttggtaggcgcccaggctgcctggtacaggagttgatgaaacagaataggaagacgttttatggtcagctgtggaagcacagtgagactgcagctttgctaactcttgcccctgttctttgcttctcgttttgttggtgaagatatcacagtgatgtctgcattcaacctgctgcatttggtgacaaagagccagccagtagcccttcgagcctgtgggcttccctcagggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcagtggcaccgccgagggaggcagtggggtcgccagcccggcccaggcagacaaagcggagctctagagtaatggagagtgatggaaacaaagtgtacttaatgcacagcttattaaaaaaatcaaaattgtta

SEQ ID NO: 17895 - DNA, 527 bp, Homo sapiens
acgttagggtgtgaccccgagccgggattccattctgcgcctgctgcgccccctcggccacctgcggggacagcccctgcctcagccgagaaggggagcagaagggttgcgccccgcgccagcgctcttgcccctgttctttgcttctcgttttgttggtgaagatatcacagtgatgtctgcattcaacctgctgcatttggtgacaaagagccagccagtagcccttcgagcctgtgggcttccctcagggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgactttt

SEQ ID NO: 17896 - DNA, 2905 bp, Homo sapiens
agtctactttccggtagcggtgccagggcagtggcctaatacggaactccatttcccggcgtgcctcgcggaggccgctgaactcagaagcgggaggccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctat

SEQ ID NO: 17897 - DNA, 2702 bp, Homo sapiens
gcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctgggaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggtgagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggtaaccactttccctctgagatgctgtataaaactggaggttaggggatatttatggttgctggtgataactttgttgttctccaggcaaaaacgtccccgaagccagcagttgtagagactg

SEQ ID NO: 17898 - DNA, 3592 bp, Homo sapiens
tgttgttgataggatggatatgtacactaacttccactttgtcactaattccgcacatggtaactccgaactctaaaactctgaccgttaagagcttgcatcgagagccactgcgagtagctgctgttatgacatggccatttcattctccacaacaagagaagcagccgcggcttcagtcaccgccctccagcagcgtaagaggataaaagtgcgacttgccctaaaacctaaacgtctcttctggatctccagaaaaaaagtgctgctctaggccgggcgcagtggctcacgcctgtaatcctagcactttggcaggccgaggcgggcggatcatctgaggtgaggacttcgagaccagcctagccaaaatggtcaaagcccgcctctactaaaaatacaaaaattagccgagcgtggtggcacgtgcctgtagtcccagctgcatgggaggctgaggccggagaatcacttgaaccctggaggcagaggttgcagcgagccaagaccgtgccactgcacttcagcccagcgttgcatgatgggagaaatagtctactttccggtagcggtgccagggcagtggcctaatacggaactccatttcccggcgtgcctcgcggaggccgctgaactcagaagcgggaggccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaaccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggaggtgaaacataggtacccccattttcatctgaagacaggacctcttgcaggtcctcataccaggcttccagctcccagctggacagtgtcccgaaggagaaaggcaatgactcagctgccatctctgcagttggatcagtctggaaaagcacatctgcaggataatggggagtggctggaacaagctccatgtagcaaacagtctatgccacaagttggcaagctggtctgatgcctgtttttgtaggtaaagttgtactggaatacagccacatctgtttattt

SEQ ID NO: 17899 - DNA, 3027 bp, Homo sapiens
gctgtcagaacgccgcctcctccgcttgcggccggtctgcaccatgctgcgaacgtccgtcctccgcctgctaggacgcacgggggctagtaggctgtctctcctggaggacttcggcccacgctactacagttcgggctccctcagtgccggcgatgatgcttgtgatgtgcgcgcctacttcactacacccattttctacgtgaacgcggcgccgcacatcgggcacctgtactcggcactactggcggacgccctatgccgccaccgtcgcctccgaggtcccagcacggccgccacgcgattctccactggtaccgacgagcacgggctgaagattcagcaggcagcagctaccgcgggcctggccccgaccgagctgtgcgaccgagtctctgagcagttccagcagcttttccaggaggccggtatctcctgcacagatttcatccgcaccacggaggcccggcaccgggtggctgtgcagcacttctggggggtgcttaagtcccgcggtctgctctacaagggcgtctatgaaggttggtattgcgcttccgacgagtgcttcctgcctgaggccaaggtcacccagcagccgggcccatcgggggattcgtttcctgtatctctcgagagcgggcatccagtctcctggaccaaggaagaaaactacattttcaggctttcccagttccggaagccactccagcggtggctgcggggcaaccctcaggcgatcacccccgaaccatttcatcacgtagttcttcagtggctggacgaggagctgcccgacctgtccgtgtctcgcagaagtagccacttgcactggggcattccggtgcccggggatgattcgcagaccatctatgtatggctggatgccctggtcaactacctcactgtaattggctacccaaatgctgagttcaaatcttggtggccggccacctctcatatcataggtaaggacattctcaaattccatgccatctattggcctgccttcctgttaggggccggcatgagcccgccacagcgcatctgtgtccattcccactggacagtctgtggccaaaagatgtccaagagcttgggcaacgtggtggatcctaggacttgccttaaccgctataccgtggatggcttccgctactttctccttcggcagggcgtccccaactgggactgtgactactatgatgaaaaggtggttaagttgctgaactccgagctggcagatgccttgggaggtctcttgaaccgatgcactgccaaaagaataaatccttctgagacctacccagccttctgcactacctgcttccctagtgagccagggttggtggggccgtcagttcgtgctcaggcagaggattatgctctggtgagcgcagtggccactttgccaaagcaggtagcagaccactatgataactttcggatatataaggctctggaggccgtgtccagctgtgtccggcaaactaatggttttgtccaaaggcatgcaccatggaagctgaactgggagagcccagtggatgctccctggctgggtactgtgcttcatgtggccttggaatgtttgcgagtctttgggactttgctgcagcctgtcaccccaagcctagctgacaagctgctgtctaggctgggggtctctgcctcagagaggagtcttggagagctctatttcttgcctcgattctatggacatccatgcccttttgaagggaggaggctgggacctgaaactgggcttttgtttccaagactagaccagtccaggacttggctggtgaaagcccaccggacctagaaactcagttcttaccggcttgtggtaaaaaagcaaatgtgttatctttttattttttattttcaggaaagttatactagtattttcttaagtgtggaatcaaatgagcacataagctgtgtccctgtgaaaagaggtttgtagcctttcaggtgcctgctcctattcatttctctgtgaccattgatcactgtcctttgtgcattgtgtgtctaagatgtcttcaggggaaagatgggtaagagacagtgttgctaatgctgttccttctttgtgcctccttccaaaccacagttatttgcccaaactacctctcgtggctggtttttcattggcctggcctctgcttctcaggctaattagtgactcctttctttgagggtcagggttggaggccccttactggtggttttacagggggatcctactttgttacacatgttgggtttcctgataaaaagagagtattttattaaacccttgaaccagtgtcctagaccagatgatttttgcccatgtgtatccccatttaaattcctacaactaagtctccctgctttgttaatagtccaacagttgggttgtgtaacatcacacttcaaccggtagatggctctaatctcacacatttacttactaaagattgaggattcggaatatttagaataaattagttttctgctttctaattttgcagatctttacatttttattgcttttcttaaaataagggatagctttgcaaccactattgttttaatggaaagcaaaaaacccccccaaacttatcagaatcctcgttctttttcagactactgaaaaatgacatttactctgttaaatgtttaataagtgaataagtaaatgtatcaagttgtttatataataaattataaaactcttgaggcacttggtatgttaaaaattttaaactttagtaacattaggttacaggtatgatttaaaaatttgtaaatagttcaaaagggcaatgttttctttatatttcttatagtcttaattttgttatccatgtgcataatttacctcatgatttcttttggtcaatcaggatctttaatacaatatagaaattgtgtaatagttattataaatgttaatacacaactttcaggtaattttaactgattatttcttttgctcttttaacttaagttattaaagtttaaaagttcgtaagt

SEQ ID NO: 17900 - DNA, 1915 bp, Homo sapiens
gaacgccgcctcctccgcttgcggccggtctgcaccatgctgcgaacgtccgtcctccgcctgctaggacgcacgggggctagtaggctgtctctcctggaggacttcggcccacgctactacagttcgggctccctcagtgccggcgatgatgcttgtgatgtgcgcgcctacttcactacacccattttctacgtgaacgcggcgccgcacatcgggcacctgtactcggcactactggcggacgccctatgccgccaccgtcgcctccgaggtcccagcacggccgccacgcgattctccactggtaccgacgagcacgggctgaagattcagcaggcagcagctaccgcgggcctggccccgaccgagctgtgcgaccgagtctctgagcagttccagcagcttttccaggaggccggtatctcctggaccaaggaagaaaactacattttcaggctttcccagttccggaagccactccagcggtggctgcggggcaaccctcaggcgatcacccccgaaccatttcatcacgtagttcttcagtggctggacgaggagctgcccgacctgtccgtgtctcgcagaagtagccacttgcactggggcattccggtgcccggggatgattcgcagaccatctatgtatggctggatgccctggtcaactacctcactgtaattggctacccaaatgctgagttcaaatcttggtggccggccacctctcatatcataggtaaggacattctcaaattccatgccatctattggcctgccttcctgttaggggccggcatgagcccgccacagcgcatctgtgtccattcccactggacagtctgtggccaaaagatgtccaagagcttgggcaacgtggtggatcctaggacttgccttaaccgctataccgtggatggcttccgctactttctccttcggcagggcgtccccaactgggactgtgactactatgatgaaaaggtggttaagttgctgaactccgagctggcagatgccttgggaggtctcttgaaccgatgcactgccaaaagaataaatccttctgagacctacccagccttctgcactacctgcttccctagtgagccagggttggtggggccgtcagttcgtgctcaggcagaggattatgctctggtgagcgcagtggccactttgccaaagcaggtagcagaccactatgataactttcggatatataaggctctggaggccgtgtccagctgtgtccggcaaactaatggttttgtccaaaggcatgcaccatggaagctgaactgggagagcccagtggatgctccctggctgggtactgtgcttcatgtggccttggaatgtttgcgagtctttgggactttgctgcagcctgtcaccccaagcctagctgacaagctgctgtctaggctgggggtctctgcctcagagaggagtcttggagagctctatttcttgcctcgattctatggacatccatgcccttttgaagggaggaggctgggacctgaaactgggcttttgtttccaagactagaccagtccaggacttggctggtgaaagcccaccggacctagaaactcagttcttaccggcttgtggtaaaaaagcaaatgtgttatctttttattttttattttcaggaaagttatactagtattttcttaagtgtggaatcaaatgagcacataagctgtgtccctgtgaaaagaggtttgtagcctttcaggtgcctgctcctattcatttctctgtgaccattgatcactgtcctttgtgcattgtgtgtctaagatgtcttcaggggaaagatgggtaagagacagtgttgctaatgctgttccttctttgtgcctccttccaaaccacagttatttgcccaaactacctctc

SEQ ID NO: 17901 - DNA, 10505 bp, Homo sapiens
gcgcgacgtcggccgtgcggggtcccggcgtcggcggcgcgcgcgctccctcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtga

SEQ ID NO: 17902 - DNA, 1052 bp, Homo sapiens
atggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctga

SEQ ID NO: 17903 - DNA, 414 bp, Homo sapiens
gcaggaacaagtaggtggggattattatccacaaaagggactagacattgtgttctgggtcccacaactcatcataaagaggtggttatagttcccatcaggagccgtgggtaggggactgtgcgtccagcagcacccgaggctcttcggcgccagaggctctaaggctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcc

SEQ ID NO: 17904 - DNA, 1685 bp, Homo sapiens
ggcgcgcgcgctccctcctctcggagagagggctgtggtaaaagccgtccggaaaatggccgccgccgccgccgccgcgccgagcggaggaggaggaggaggcgaggaggagagactggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaa

SEQ ID NO: 17905 - DNA, 9892 bp, Homo sapiens
ccggcgtcggcggcgcgcgcgctccctcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaattt

SEQ ID NO: 17906 - DNA, 3259 bp, Homo sapiens
aaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccactt

SEQ ID NO: 17907 - DNA, 2980 bp, Homo sapiens
aaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccactt

SEQ ID NO: 17908 - DNA, 2090 bp, Homo sapiens
aaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtggaaccaaccacccaaccccagtattctggtaattttgacaatgatctatatgaaatttatttgattgacatttag

SEQ ID NO: 17909 - DNA, 3091 bp, Homo sapiens
aaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccactt

SEQ ID NO: 17910 - DNA, 2953 bp, Homo sapiens
aaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccactt

SEQ ID NO: 17911 - DNA, 2820 bp, Homo sapiens
gcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttacttac

SEQ ID NO: 17912 - DNA, 2434 bp, Homo sapiens
aaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtattaccaccttgctcttgactggaaatgcaactgtggttaccacctgtgctgcaggtccgtcctggttccctgatttgtgtttcctgttctgcctggatcctgattctcagaaaccagttactggacttctgatccacatcctga

SEQ ID NO: 17913 - DNA, 1512 bp, Homo sapiens
atggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtag

SEQ ID NO: 17914 - DNA, 1845 bp, Homo sapiens
gcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaag

SEQ ID NO: 17915 - DNA, 2801 bp, Homo sapiens
agccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctcta

SEQ ID NO: 17916 - DNA, 2179 bp, Homo sapiens
attgtggctcagaacgctgacggggaggaatgaagggccctcaggccgataagggggaggaatggcggcgtcggaatactgacgaggagaaatggggggatttaggctgaggacgggaaggaatgcagctctgaactctgacaggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggcaccttgctcaccgcctgcgtcgccgtcatcagagatgtcagcgacgcactcccctggctgtggctcccccaactggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctgg

SEQ ID NO: 17917 - DNA, 3052 bp, Homo sapiens
aaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccactt

SEQ ID NO: 17918 - DNA, 2473 bp, Homo sapiens
aggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggcaccttgctcaccgcctgcgtcgccgtcatcagagatgtcagcgacgcactcccctggctgtggctcccccaactggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaagg

SEQ ID NO: 17919 - DNA, 2532 bp, Homo sapiens
ggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtattaccaccttgctcttgactggaaatgcaactgtggttaccacctgtgctgcaggtccgtcctggttccctgatttgtgtttcctgttctgcctggatcctgattctcagaaaccagttactggacttctgatccacatcctgaccctggtccactgtgaccctcagactcttaattatgctccaccaggtcgtgccactgccccactagtccatttgatctgcccccatcctaggatatcctgagtctaagccctggtttctgccaatggcaaataggaagattttattaacaggttttaaaaaattattattattactggttatttggtttgacaaggcacttaggctccctgagctttgccttagctggaaaataaggatagtattacttgctattctatcaaccctgtaagatatttgcggccacgcgcggtagcgcaccctgtaattccaacactttgggaggccggcgggaggggcagtggggaggatcgcttgaacccaggagcaggagttccagcctgagcaacatagcgggaccccctgtctcttcaaaatttgtttttaaattagcagggcgtggtggcgcaggctttgtagtcccagatactctggaggctgaggcccaggaggacgaggctgcagggagccatgatcacgccactgcactccaccctgggcgacagagcgagaccttgtctcagaaaaaatctgtgaggttaaaaggctgtgtgtgtgaaaatatcttggaaattgtaaagaactacacaaatataa

SEQ ID NO: 17920 - DNA, 1945 bp, Homo sapiens
atgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctg

SEQ ID NO: 17921 - DNA, 2913 bp, Homo sapiens
gatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaa

SEQ ID NO: 17922 - DNA, 5188 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacagactgattggaattctttctgttgaaaagcacacacaataaagaacccctcgttagccttcctctgatttacattcaactctgatccctgggccttaggtttgacatggaggtggaggaagatagcgcatatatttgcagtatgaactattgcctctggacgttgtgagaattgtgctttcaccagaatttctaagaatttctgctaaatatcacctagcatgtgtaattttttttccttgcctgtgacttggacttttgatagttctataagaataaggctttttcttcccttgggcatgagtcagatacacaaggacccttcaggtgttactagaaggcgtccatgtttattgttttttaaagaatgtttggcactctctaacgtccactagcttactgagttatcaggtgcaggtcagactcttggctacagtgagaggcagcttctagacagagttgcttaatgaaagggtttgtaatactttacaaaccattacctgtacctggcctggcctccaaaatattaacattctttttctgttgaaactcgcgagtgtaactttcataccacttgaatttattgatatttaattatgaaaactagcattacattattaaacgatttctaaaatcaaaacatacttaatctgataccaaggaagggagggagtggttataagcaaatgaaaacaaattttgagagacagagcaaaagtaaaatcattctatagaaaaggtgtgtttatttcttaactcttgagttcttttaaaattagaacctaaatgatgcagtcaggggtatgaccaattccacatgagtgtcacctgtacattttattaccactacctccagtttccaaggcagggaagaagaggggaatagtcaaagcaatatgactagctaggtttgggctgctgtttgggctgctgtttttcctggacttttatgccaaactacataaatacttcttggaattcctgatttacgctcaactttgatccctggaccctagggccattagtttccttgaagcagtcctgctggtggatgagcagggaaacttgtagaccctgggaagccaattggtagagggtgcctgcccgccccatcagactgtcccaactggggtgggggtgaggatcatagtgatttctttttaaaagctagtatgactagtgagaatggatgtccaagggcttttctcttcctcccccgagtccacgattcttcatttgtgatcagggttggggtaacttcaccttggtgatcatatattctttttacaaaccaatccagccaagatatatgtgcttttctaaacagcttgtaaaagcaaaaacacaatgtatacacatataaaactgatttttttttttttgcttatatactttgctcaggtggagaacaaggtatgaaagccattatatggtgtcccttggggaccatcccataagtccagggtgttcccaatatacccacaagacaacatgttcaaaacttcatcacctggtccccacaaacctaccaccctcttccattccctcactctggtaaaagcaagccatcttctccagttacgcaaggcagaagcccaggagtgagcacaatgctgccctttcccttgcttctgacttctcatcaatcctattagaactactgactgcaccccacctctcctccatccccacgatcactgccttcatatgaactgcctttcctgtcctctggactttcagtggcttccttttttgctcacctgtccactttcttccccttccctctctccatccctccacatagtcatcagaaagatcatcaaaacaggcaaatgtgactgtattatttccctcacttatctttgtatgcagtttagagtgatttttaagagcacacactttgaaattaggagaacctgtgtctgaatcctgatttttgccatttgtgtgacttgtcaggttatttaatctctttgagcctgtccctcctcagtgaaataggaataataatacctacctcatagagttgttgtgaggattcagtgagatagactgtttctaaagtgtgtagcacagtgcctggcacatagtgggtgctcacattggagcacactattgtcgctatccctgcaggtgtgagttttacatcctttccaagaggcatttgctaataaccctaactaccgcctatccctgtgacactattttctgcctcagcaccctatttcttttgtagacattttctaagtctgtattttatttatttgttggctttttgtctatttctctactagaatgtaagctccatgagagcaaggatgtgtttgtctgatttcccgttacagccccagcacttagctgagtgactggcacctagtaagcactcagtaactgtttgctgaataaatggaagaatggtcaaaaggctcttcttgatctgatccctgcttgtctgtctggcctcatgctgccactattcctcactgcaccttcagctcaagaaaaacctctttacttgcttctttgaagtgccccttgggcctctgtgtctttgtacctgttgttccctttgcctgaaacaccctttgcctgcccgtctacatggtgaattcctaatcattgatgaagtctcagctcaatggctacctcctctgtgaagctgtccctgatttcttcaggcagatgttctttcccgccttccctgttcccaccgcactttgtaaatacctccatggaagcactttattgtattgtattgtaatttttttttgcatgtctgtttctactattagactgtaagcaccgtaaaagcagagattgtgctttttcatcctcatgttccccgagcctagcccagtgcctggcacgtaatagcttgtcattaaatatttgttgaatgaatctgtgaatgaacaagagtcatgcagttggaaaagtgttagaagctgtatgtattataaaggaaagaaatgcccttggtggcttccagggtgtttttttttttttttttggtctaaagaggagatctagagagtgttatacaatctctttgaatataagattactcgtttggatttttaaaataatatagatcttcataaataattgcaaagatataaacaagctttgtgatttctcaaatgctatgaagtccaaaataaatatttgcactattagtatttccatagtaaatgctatgagaaaatgtacagcaataaattttgaagctttaaaactgtt

SEQ ID NO: 17923 - DNA, 1357 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagctgcgctggaacactcatcgtcctgcaccatggcatgcgctttcaagactctgcttgctcatacgctgtttgctctgcttggaatgtgcttacccccttccccttcatctggtgaactcctactcatccaagacccagcttcattgtctccatctctgggaagcctgccctgcatactccaggcagaaccaatcctttcctccataatgcttccctggtgctttgccattgtatttgtgacttgtttgtctgcttcagctagactgtgagctccatgagggcagggaccatgtctttttttgcttttgcacacggtaggtacttaatattgctttatgtttatttgatttaccatccacctcattctagaagtgtatagtggtaataaatgtttattaaataaataaattataccgtacattattt

SEQ ID NO: 17924 - DNA, 1182 bp, Homo sapiens
cgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagctgcgctggaacactcatcgtcctgcaccatggcatgcgctttcaagactctgcttgctcatacgctgtttgctctgcttggaatgtgcttacccccttccccttcatctggtgaactcctactcatccaagacccagcttcattgtctccatctctgggaagcctgccctgcatactccaggcagaaccaatcctttcctccataatgcttccctggtgctttgccattgtatttgtgacttgtttgtctgcttcagctagactgtgagctccatgagggcagggaccatgtctttttttgcttttgcacacggtaggtacttaatattgctttatgtttatttgatttaccatccacctcattctagaagtgtatagtggtaataaatgtttattaaataaataaattataccgtacatt

SEQ ID NO: 17925 - DNA, 2559 bp, Homo sapiens
gcgggccgaggagccgggcgcaatggagcggaagaggtgggagtgcccggcgctcccgcagggctgggagagggaagaagtgcccagaaggtcggggctgtcggccggccacagggatgtcttttactatagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcaggtgctgcggggccacgggggctccctggagtcgggtcctggcagtggggactgcctggtgaacacagatgtgcttgggatgacgggtgcctcccaagagcttcccatctccctagaagagcccaagcgtccccgtcccgtggagtcgctaaagccagccctccctgtcctttccagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcatgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgg

SEQ ID NO: 17926 - DNA, 2345 bp, Homo sapiens
gaggcagctgaggcggcggcggcgagtgggggtccgggcggcggcggcgggcccggcggcgggccgaggagccgggcgcaatggagcggaagagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcatgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgg

SEQ ID NO: 17927 - DNA, 5992 bp, Homo sapiens
aaccaaccagccacccgtcagagagggacatgcgcactccagggaaggcactcaaaagtggggggcaggaaagatgtacattgaagatgtcagtttctacatgtgggaagtagacattgaaggctttatggtttacagacaagatctttagaagataagcactaaaggaccaaggaaataaataccagaaatcaagaagagcacacactattttccttcatcaatccatagaaccctaatgcttctttagttccatcaaacacagaggaatgaccaccatggcagatggcaacagaggatgtcaacaattttttggagagagaagaggtactcccttatagggactcgtaaagacatagagcatctggaaattaactgcctccattacactgctgagtcacacacaacgcttgttatgttttcatcacttctctccagaaggctacattattggaattttgaagtcatgaaaacatcagatgaaccaacctgcaacaccttggattcagattggaagataaagagaaagtttaaagaatgtggcctataaaggcgggtacctggaaatattaaccgactcacactgtaaaaatgagaccagtttctaaacaatagagattgtcttagtacaacatcaaggttcaagacaaatgttgaactaaaaactttacactccccacccccacttcagacaggtaccagcattggtgaattatgattttccttagtcagaagcactcatttttacccatgtagaccatccttaggaattaaatattggttatttaatgtagattataatgggaagctgatttttttcacaatggcatatttcaaggacttggttccaaactgagctgaagcttcccaatgcgttttgtacagtctgggaaaaactgtgctgcactggcccacttttgaaggccatcatgctctgtaatataaggatatcatcttattgctgatatctttggagagtccctagcagacacagaaaatgaatggaggcaaagagtgtgacggaggggacaaggaaggaggtcttccagctatacaagttcctgtgggttggcagcgtcgtgtggatcaaaatggagtgctttatgtcagtcccagtgggtctttgttatcttgcttggagcaggttaaaacatacctgcttactgatggaacatgcaagtgtggcttggaatgtcctcttattcttcccaaggtatttaattttgatcctggagctgctgtgaaacagagaaccgcagaagatgttaaggcagatgaagatgtcacaaagctatgcatacataaaagaaaaattattgcagtggccacacttcataaaagcatggaagccccacatccttctctggtgctcaccagtcccggaggaggaacaaatgcaactccagtagtaccttctcgggcagcaactccaagatcagtaagaaataagtctcatgaaggaattacaaattctgtaatgcctgaatgtaagaatcctttcaagttaatgattggatcatcaaatgccatgggaaggctatatgtacaagaactgcctggaagccaacaacaagaactccaccctgtctacccccgacagagattgggcagcagtgaacatggacagaaatctccattccgtggcagccatggaggcctgcccagcccagcgtcatcaggttcccagatatatggagatggttcaatctctccaaggactgacccacttggaagtcctgatgttttcacaagaagtaatcctggttttcatggagctcccaattctagtcctattcacctgaataggactcctctttctccaccttcagtaatgctacatggttctcctgtacagtcatcctgtgcaatggctggaaggactaatatacctctttccccaaccttgactacaaagagtccagtaatgaaaaaaccaatgtgtaatttttcaactaatatggaaataccacgagcaatgttccaccacaaaccaccccaaggcccacctccccctcctccaccttcttgtgctcttcagaaaaagccattaacatctgagaaagatccacttggcattcttgaccctattcctagtaaaccagtgaatcagaaccctgttatcattaatccaaccagtttccattcaaatgtccactctcaggtacctatgatgaatgtaagcatgcctcctgctgttgttcctttgccaagtaatctcccattgccaactgtaaaacctggtcacatgaatcatgggagtcatgtacaaagagttcagcattcagcttcaacctccctgtccccttctccagtgacatcccccgtgcacatgatggggactggaattggaaggattgaggcatcgccccaaagatcacgctcatcttccacatcatcagatcatggaaatttcatgatgccacctgtaggaccccaggccacttctagtggtattaaggttccacccaggtcaccaaggtcaacaatagggtccccaaggccatcaatgccatcaagcccttctaccaagtccgatggacatcatcagtacaaggatatccctaacccattaattgctggaataagtaatgtactaaataccccaagcagtgcagcttttcctactgcatctgccggaagtagttctgtaaagagtcagcctggtttgctgggaatgcctttaaatcagatcttgaaccagcacaatgctgcctcctttccagcaagtagtttactctcagcagcagccaaagcacagctagcaaatcaaaacaaacttgctggtaacaacagtagcagcagtagcaattctggagctgttgccggcagtggcaacactgaaggacatagcactttaaacaccatgttccctcctactgccaacatgcttctcccaacaggtgaagggcaaagtggtcgagcagcactaagagataagctgatgtctcagcaaaaagacgcattgcggaaaagaaaacaaccacctacgacagtgttgagtttgctcagacagtctcaaatggatagttctgcagttcctaaacctggacctgacttgctaaggaagcagggtcagggttcatttcccatcagttcaatgtctcagttactacagtctatgagttgtcaaagctctcacttgagtagcaatagtaccccgggttgtggggcctcaaatactgctttgccttgctctgctaaccagctgcattttacagatcccagtatgaactctagtgttcttcagaacatacctttaagaggggaagccgtgcactgccacaatgcaaacactaactttgttcacagtaacagtccagtccccaaccaccatcttgcaggtttaataaatcagattcaggctagcgggaactgtgggatgctcagtcagtcgggcatggctttaggaaattccttacatcccaatccacctcagtcaagaatttcaacgtcctccactccagtgataccaaacagcattgttagcagctataatcaaacaagttctgaagcaggcggttcaggaccatcatcctccatagccatagcgggcaccaaccaccctgccatcacaaagacaacatctgttcttcaagatggcgtcatagtcaccactgcagctggaaacccactgcagagtcagctacccattgggagtgattttccttttgttggccaggagcacgcacttcattttccatccaacagcacttcaaacaaccatcttccacaccccttgaaccccagcctcctcagttctctacctatctctttgccagtgaatcaacagcatctcctaaaccagaatctattaaatatcctccagccttcagcaggagaaggtgatatgtcatcaataaacaatactttgagtaaccatcaactgactcatctacagtcgctgttaaacaacaatcagatgtttcctccaaatcagcaacagcagcaacttctccaggggtaccagaatctccaggcgttccaaggacagtccacaattccttgcccagctaacaataaccccatggcttgtctgtttcagaactttcaggtgagaatgcaggaagatgcagctctcctaaacaaaagaataagcactcagcctgggctcacagcacttcctgagaatccaaacactacacttccaccttttcaagatacaccttgtgagttgcaaccgaggattgacccatctcttggtcaacaggtgaaggatggcctcgttgtgggtggcccaggtgatgcttccgtagatgccatttacaaagcagttgtcgatgcagccagcaaaggaatgcaggttgtcatcaccactgcagtcaacagtacaactcagatcagccccattccagctctgagtgccatgagtgccttcactgcctcaattggtgacccattaaatctctccagtgctgtcagtgcggtcattcatggacggaacatgggaggtgttgatcatgatggtaggctgaggaattcaagaggggctcggctgcccaagaatctagaccatgggaaaaatgtgaacgaaggagatgggtttgaatatttcaagtcagcaagttgccacacatccaaaaaacagtgggacggggagcaaagccccagaggggagcgaaacaggtggaagtacgaggaatttttagatcatccaggccatatccacagtagtccttgtcatgaaaggcccaacaatgtctctacactgccatttctgcctggggaacagcacccaatactgttaccaccaagaaactgtccaggggataaaattctagaggaaaatttcaggtataataactacaaaagaactatgatgagttttaaggagagactagagaacactgtggaaagatgtgcacacataaatgggaatagacctcgacagagtcggggatttggagagctgctaagcactgcaaagcaagacctggtcctagaggagcagtctccaagttcctcaaatagtttggaaaattctctggtcaaagactacatccattacaatggagactttaatgccaaaagcgttaatgggtgtgtgcctagcccttcagatgctaaaagcattagtagtgaagatgacctaaggaacccagactccccctcttcaaatgaattgatacattatagaccaaggacgttcaatgttggcgacttggtctggggccaaatcaaaggactgacttcctggcctggaaaattagtaagagaagacgacgttcacaattcatgtcaacaaagccccgaggaagggaaggtggagcccgagaagttgaagacactaacagaaggtttggaagcctacagccgtgtccggaaaaggaacagaaaaagtggaaagctaaataaccatttagaagctgctattcatgaggccatgagtgaactggacaaaatgtctgggactgtacaccaaatcccacagggtgacagacaaatgagaccccccaaacccaagaggaggaagatctccagataacagagactactccactaatgcgcagtgtttattaaaggaacatgcacagatgtatctgtatataggtattgatatagccacagttatatcaatatttagactatggcagatagctaccaccaccacagggtgctaaaagaaacagtgatacaaaatttttttgatcaggaaggataatgaatgctggaaaagccaatcaaagtctctgtgtgatgagagtgatcaatggtcaagagattactgagaaactctttttctataatactaaattgtgattataagaaatagtccaaatgtttctgaagaattttcaatgttgtatatagaaaatacagaatttcatggtgatatcagaaatgtaaatattgtacagtattgtcatgtacaagcgtacctaatgcacactttatcttttattgtacaaagaaatagtgtacaaaattctttggtttctatggagtacacctaccagagactaccagtgtaaagtgataaataaaaatacaacct

SEQ ID NO: 17928 - DNA, 2545 bp, Homo sapiens
acattcttggatcagcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagccaa

SEQ ID NO: 17929 - DNA, 2156 bp, Homo sapiens
agtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggcagatgaagcatattccatcggccccgctccctcccagcagagctacctatctatggagaaaatcattcaagtggccaagacctctgctgcacagcacatccaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagcc

SEQ ID NO: 17930 - DNA, 1905 bp, Homo sapiens
gacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacttgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactca

SEQ ID NO: 17931 - DNA, 1860 bp, Homo sapiens
agtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctc

SEQ ID NO: 17932 - DNA, 1067 bp, Homo sapiens
atcagcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaaggggagaagctgcagtcagagctgctaa

SEQ ID NO: 17933 - DNA, 1988 bp, Homo sapiens
ggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacaggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttacggttatcctttctgacccacaaagtatgaaaagttctgtaatctgtaaactcagttctgtaatctgtattattgagatgattaatataaagttgtattttcactg

SEQ ID NO: 17934 - DNA, 3665 bp, Homo sapiens
agaatcagagaaaccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttacggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctccccatttccccctcccccgagcccatgacatctccttattattattttttttttgagacagggtgtttctctgttgcccaggctggagtgcggtggtgtgatctcggctcactgcagcttccacctcccgggttcaagcgattcttgtgcctcagcctcccaagcagctgggactataggcacgcaccaccacacccagctaagttctgtatttttagcagagacgggatttcactaggttgcccaggctggtctcaaactactgacctcaagtgatccacccgcctcggcctcccaaagtgctgggattacaggtgtgagccaccgcgcctgaccacatctccttattcttaaatgtatgtgtttctcatggtttgatttattcttgctgggccatttcagcccctgtcatggcttcactcgccatctaaatgcagatgattactgccttgacggttcttaacccagctctcccctgagctgcaggcctgcatatccagtaggtctactggacatctgtactggttgttgtggaggaacctctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcagattactcccttcagtgatttcttgtagaagtgccaatccctgaatgccaccaagatcttaatcttcacatctttaatcttatctctttgactcctctttacaccggagaacggctccagctgttctagctctctttcagttctttgaaccttcccaccttagggtctataaggttccctctgcccaaattgttctactctcccttcttcttcaacacatccttcagtttaagcacttgcttctctcagtttaaactccacttccttagggatgtctctgtgacctccctgtgctggattagcttccctactctatgctcttgtaaaacactatctacttcctttgtcataaactcatcattttcctataaacattaatattgtcctcctgctagaatgtaagctccgtgagagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatgaccgaatagaactatcaaatgttttcctaataaagtcaatatttcaaa

SEQ ID NO: 17935 - DNA, 2300 bp, Homo sapiens
gcggccgccttggccgagcgccggcgttgggcagaagcacagcaccctccgtaagggcaccgggagagcccgggagtgcgttccggggctttcggagcagcggtgtgagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagcaatagtggaaaaataaaaaaataagtaaacagaaaaaactaaagttgtattttcccacaaatatagtatgaatgaggtcatattaaagaacagcaactgttaatgtttgttcacaaattcagaaatctaataggaaaacatgatactttcaatgtgccaaaactaaaccttagtatacaactaaaaatctcctgccttcttgcctacctgtcttccctcttctgttacagaatttgttcctcaaagtagatgcaatgtttctaacacaatttaaattaggaaatatatatgaatgtcgttgaagtctattttgagactgctaaagctattaattgatactgtgtttttatgcccaaatcccagtatgtttatgtaccaataatgactcttacccagcgcatgtctttatcagtgtgtactcgtgacgatttgtgtgaaaatagacttgatgtttataattaataccattacaactgtataataaaagcaatttgaagaaaa

SEQ ID NO: 17936 - DNA, 873 bp, Homo sapiens
cagtccggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcagagagatttcaccattttgcccaggacctctccaactcctga

SEQ ID NO: 17937 - DNA, 955 bp, Homo sapiens
ggtccgcggcttctcgctgctccgcggccgccttggccgagcgccggcgttgggcagaagcacagcaccctccgtaagggcaccgggagagcccgggagtgcgttccggggctttcggagcagcggtgtgaggaccagcagagagaagagattccatcttccagagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagc

SEQ ID NO: 17938 - DNA, 2354 bp, Homo sapiens
cagtccggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagcaatagtggaaaaataaaaaaataagtaaacagaaaaaactaaagttgtattttcccacaaatatagtatgaatgaggtcatattaaagaacagcaactgttaatgtttgttcacaaattcagaaatctaataggaaaacatgatactttcaatgtgccaaaactaaaccttagtatacaactaaaaatctcctgccttcttgcctacctgtcttccctcttctgttacagaatttgttcctcaaagtagatgcaatgtttctaacacaatttaaattaggaaatatatatgaatgtcgttgaagtctattttgagactgctaaagctattaattgatactgtgtttttatgcccaaatcccagtatgtttatgtaccaataatgactcttacccagcgcatgtctttatcagtgtgtactcgtgacgatttgtgtgaaaatagacttgatgtttataattaataccattacaactgtataataaaagcaatttg

SEQ ID NO: 17939 - DNA, 1407 bp, Homo sapiens
agtgtgaagcttattcatgaagagacctctgcctgaacatacagcaaatttaagaaggttgtgcagatagtctgaaggaggaccagcagagagaagagattccatcttccagagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcagagagatttcaccattttgcccaggacctctccaactcctgaactcaagcgatccacctgcctcagcttcccaaagtgctgagattacaggcatgagccaccacacccggcactatataagtattttagaccttagaaaaacctatctagttttaaatttgtcttattaattttcttgacattgctaaaaaaagaagcatgtatatccattcatgcaatattcctcagcagtgaaaaggaatgaactattgatacagcaacctgaatgaatttccagcaaattatgaagtaaaaaaggcaatctcacatgttctttgttcaatcatagaatatatgattccatttatatagcattcttgaaagtgacaaaattagcggtttccgggagtcaaggacaggttgatgtgggagggaactgggtgtggctgtaataaggcaacatgagggacccttttgatgatggaaatgttctatatcttaactgtatcaatgtcaatatcctgggtataatattgtcctgtagtttggcaagatattatcattgtatagtatcttgtattatttcttacaatggatgtgaatctataattatcaaaaaatgacaatttaattaaagcatatagtaaataagt

SEQ ID NO: 17940 - DNA, 7068 bp, Homo sapiens
accagtaattcattttttattattctgtattcagtaagaatcaacctgtatcaaatagctgaaaaggcctgaagcctcccaaatgcatatcattacacaaattctgtgtgaggactgacatcttggtttcatatactaattatactgcatgggccccatttataaccatatctactcgtcatttgatcctggctactgccgatggatgctatcttcatcacattatagcaaacatttgggtgattaagtttttctcaaaaattctagattagcatacaacggctttactacttatatgtcatctaagacgttttttaagaattagttactactacgcccaacgcagtgaggtagcaaatattatgcctgtttattttcatctccatttcaggcttgcgcgcctttcccccctcgggacttcccgaggacacccctgcagcagtgagcccgagtcctggctttggctgcatgttaagaaatattaatcaaaatgaatgcgtgccctttaagagaaaaaaactgtgggtccttcagcctttaaaaaccatgccgtggtttaaaaacttaaaactatatttcggcagaacgctgagcatttcttcaaatcactctgagaagcttgagtgtctttaatttcaccggtctgtcaaacgtaacgcgtctctccctcaccccacattttaagtttccaaggagcggaagaagggcctccgggggtcccggccgccgcaggctgctgggggtgaggacacgactcggcctccgtccgactcgagggtgtcgcgaaggccaggagggaacgaaagttaccctcgaacttcggaggcgaaagatttcatgtggatcttaaaaagggcaaaacctaccccaaaggccgtaaaccgccctcccctcccccgccagagaacttcccggcgcagagcttccgcagcctgctgcaggccgggagaccttcacgctcactcgctctccgccacacgccggaactgcgcggccacgtccacggggaccctggccatgccccgcaccgccacccagccccaggcgatccccgggccccacgcgcctgcagtcggcgctgcgcctgcgtgggaggatccggcggaaggggcggggtcaggtggcacttccgtggcttcgggcggggaggtcacaatcacattgagccaaaacgcatccagtgttttctccagttacaaataaaacgaatatgcccatgctgctaccacatcctcaccagcatttcctaaaaggccttttaagagcacctttccgatgttaccacttcatctttcactcaagtactcatctcggatcaggaatcccatgtgctcagccgtttaattctcttggactccattgtacaaagtggatgctgctgtcagatggcttaaagagaaaattatgtgtacaaacaaccttaaaggaccacacagaaggactttctgataaagagcaaagatttgtggataaactttatactggtttaatccaagggcaaagggcctgtttagcagaggccataactcttgtagaatcaactcacagcaggaaaaaggagttagcccaggtgcttcttcagaaagtattactttaccacagagaacaagaacaatcaaataaaggaaaaccactagcatttcgagtaggattgtctgggccccctggtgctggaaaatcaacatttatagaatattttggaaaaatgcttactgagagagggcacaaattatctgtgctagctgtggacccttcttcttgtactagtggtggatcactcttaggtgataaaacccgaatgactgagttatcaagagatatgaatgcatacatcaggccatctcctactagaggaactttaggaggcgtgacaaggaccacaaatgaagctattctgttgtgtgaaggagcgggatatgacataattcttattgaaaccgttggtgtgggtcagtcggagtttgctgttgctgacatggttgacatgtttgttttactactgccaccagcaggaggagatgagctgcagggtatcaaaaggggtataatcgagatggcagatctggtagctgtaactaaatctgatggagacttgattgtgccagctcgaaggatacaagcggaatatgtgagtgcactgaaattactccgcaaacgttcacaagtctggaaaccaaaggtaattcgtatttctgcccgaagtggagaggggatctctgaaatgtgggataaaatgaaagatttccaggacctaatgcttgccagtggggagctgactgccaaacgacggaagcaacagaaagtttggatgtggaatctcattcaggaaagtgtgttagagcatttcaggacccaccccacagtccgggaacagattccacttctggaacaaaaggttctcattggggccctgtccccaggactagcagcagacttcttgttaaaagcttttaaaagcagagactaataaaattcatcctgtataataattttacatatcatttcataaagtattttaatagaaaaatcacttgtatgcttatattttcagtaattattgtatggtgctcttgtcttctttgtttgtgacccatgcttgaaaacttgaaggaagttagatatgaatggcaaaagttaggcagtatttataaggtacctgttttatgttactgatatctgtttccttctcttcttataccctggcatggtggcctgtagggtagtttcttcttaatagtcaagaacagagaaagctgaggagagcagaaaatatcttgcactttaaaatgcttattttgattccatattatctgaatttccagagaggatgtaaacaagagtgaccatatttttggagtccttcttgaagccagaacaacacacagtgggttgctaagagccgacaatcataattgacatttagtgtaccagattattctaagaatttctgaaattaccatgtacatgagtaatgaaacaactggaataatgtgatgatgtgaacacaattttaaagtctgcttgtctggatttgcaggtacccttccgccaccccccaacatgataggtaagagagcaaaagggaactgggaaaaatcagctacaaataaaatgggtgactaatccccagttcttggacccattatatttgtagccaattggagtaaacccctaaaagacaaagtgaggtcagaatgattcaaggattattcagtttgaagactaccaaaggcttttgcttctcttcttccttggccatttcacttcattttagtattttaaaaatcttttttcttgatggtgaacaagttttgtcctatgctatggaggaggcatagcacagtgattaagagcttgggctctgtagttggactatgtgggtttaaactttaaacccagatcaattgtatattagctacatgagctaatctctttaagcttccatttcctccctggtaaaatgaaattggcaaataactttctaaggttagtgaagataggaaatactcgaaggctgcttactatccttattacattaaagttatgggtatcttgaaactacaaacctgatgtataatttcagttttctctcatggtcttgttactaccatcatactcttgatattttaggatactttaggattacctttgaagaaccctttctagttaattctttgaatatgttttatacttatttgatggtagttgtaactgtgtacatttgaataaaatttctaaccataaaatttcgccattgcacaaaaagcctttatagaagtttctaacatattctattctgaaccctgtagaatattttatgtagtatagcagcttgcattgttacttactgtactggaatcaaacctcttgagcattattttaacaaacatccctttacattttttggaaagatttttagtactccattggcatagctatttcatacaaggattaggagaaactttgaaaggttatccacttgacttttctgattttagaaaggactaccattaaaccaccctatcagacaaaaaaaactggtttttagaaacctgagagaaggaattttataatttccctgagtaagctgttacagggaataacaaatctcctgccacatgtggcacagtgtaagtaatgctggagcacacatactgcattgtaaagaaggtaggaaaggtggggggacttttgttagctttaattttaaggctaaaagcatttcttctcagtttgaactacttttaaatgttataaatgtcatcataaaaatcattagaaaactcatttctccttatgttgtcgttgtaccattgggtattgtatagagaccaatttctaagagattttttcacctctgtttctgttatttgctatactggaggtaatataataataatgaaatatagctttttttttcaactcagaaatcctattccctctccccatctgtgattatattgtactggacttctgacttggtcaaaagcataggttttgacttagatacatgtgggggcagatctcagctctatcactaactagctatatgatatttggcaagttttttctctatgtgcagtagtttctttatctgtaaaattaagataatagctactttacagggttggaagaattaatttagaaattgtacagtgcttagcctcaataattggtaggtggtggtgtaaatattttacatagatacttgtgacagttctttgttctacaaaacagactaatattaatttcagattggccaagctacttaatttctctgtgcctcagtttcctcactattaaatggggatgacaatagtgtccacctagagcaggactattttagtattacatataatccttggatataaatgctgatgaagtttggatatttgtccccacccaagtctcatgttgaaatgtaatccccaatcttggaggtggagcctggtgggaggtgtatggattagatcagatctctcatgaatgacttgggccatcctttgggtggtaagtgagctcttgctccgagttcacacgaggtctagatctggtcatttaaaagtgtgtggcatctccccatccctcactctatcacttgctcctactttcgtcatatgacatgcctgctcccctttcaccttctgccatgattgtaagcttcctgaggcctccctagaagctgagcagatgccagcaccatgcttcctgtagtctgtagaaccataagccaaataaacatcttttctttataaatttataaattacccagtcgcagatatttatagaaagaacagcctaatacaggtgctaaatacatatctgacaataaatggtagttatctcttagaactgttatgaggattaaacgagttacagtgtccatcttaaaaagataattctgaaaaaaatctcataggttcactttgccttgtcaagaatatgattaccattaacttctgtagataggaaaaaaatgtgctgagctccaaaactgacagacattttgctaaaacaatatcaaatctcattaaaatgatgacagttatttcaatagttgacagtagctatcccaatacaacctaacaaggcattttctcttcagaatcactcgatcatatggccatttccctaagcttttatagctattgcccagtgtacactgaagacaacagctaacgaacaacatacgtgtgataatttatgtagttgaacctctaaggcaaaaaaaaaaaaaaaaaggaaaaattagtgaaaatcattcaaacattatgctcaccaggtagactgccatcatagaagtcctaatgctactgctaaaaactagtaaactaccagtaaactgtgaagacagaagtaactcctgtgatctatatgtttgtgcagatggtggagcttttctgctcctaaagcctgagaaatgcaaatgtggcttcgttaatgcaaatgcttcctacgccagactttatgaaactcctcctaaagttgaattcttatccaagtggacatatgttagggtgccattgtaattcaggtagagtgtcagagtggtggctggcaccaacggtagatgttctcaacattagcgttattcaggtaagactacaacaatgatgaacatgtcaaaactttcctttaaaaggaacaatcagaaaaactctttaacaaatgtttttctttccgtagtattttaattaaaatttttaaaattttaaaatttactaaatttatgaacgtttttatcccacttgagatgaatacttatttatagtccctgtcccatgaagcttctgtggatttgctttgtttgtcatttgtggtatgtttgataacaaaaatattagtggcacaaaagcagttatattgaatgcttttgttttagagaaaatttcactctgtactagaaaatgtagatgatgtgagtcaaagttcattaatatttacctgaaaatttgtgtataaaggtaaccttggggcagtttattttgcttagacccctcagcttcttgatagagtgaggtgagggcatatgtaagtcagtaaactattctgttagtaaagtcaaaggcgtaatctaaattaattatgcttttaactaacacagaagaaatcatgtgacctcattctcaaagctcgtaacatccacctggccaatcttaagatgtggatagagttcttttttttcttttttcaatttttacaataatttttgacacattgaagctgtgcatgtttatgggggcacaatttgatgtttcaatacatgtatatgttgtgtaatgatcaaatcggagtacttagcatatctatcatctcgtgcatttatcatttctttgtggcgagaacatttaaaaatcctattttctagctattttgtaatatacactaccttactgttgcgaaccatagtcaccctactgtgcaatagaacacctgaacttattcctcctatctagttgtaactttgtacccattgaccccccttcccttccttccactctcccctccccagtctctggtaaccactgttctgttccctatgagataaaactttttttgtcttccata

SEQ ID NO: 17941 - DNA, 1437 bp, Homo sapiens
gagccaaaacgcatccagtgttttctccagttacaaataaaacgaatatgcccatgctgctaccacatcctcaccagcatttcctaaaaggccttttaagagcacctttccgatgttaccacttcatctttcactcaagtactcatctcggatcaggaatcccatgtgctcagccgtttaattctcttggactccattgtacaaagtggatgctgctgtcagatggcttaaagagaaaattatgtgtacaaacaaccttaaaggaccacacagaaggactttctgataaagagcaaagatttgtggataaactttatactggtttaatccaagggcaaagggcctgtttagcagaggccataactcttgtagaatcaactcacagcaggaaaaaggagttagcccaggtgcttcttcagaaagtattactttaccacagagaacaagaacaatcaaataaaggaaaaccactagcatttcgagtaggattgtctgggccccctggtgctggaaaatcaacatttatagaatattttggaaaaatgcttactgagagagggcacaaattatctgtgctagctgtggacccttcttcttgtactagtggtggatcactcttaggtgataaaacccgaatgactgagttatcaagagatatgaatgcatacatcaggccatctcctactagaggaactttaggaggcgtgacaaggaccacaaatgaagctattctgttgtgtgaaggagcgggatatgacataattcttattgaaaccgttggtgtgggtcagtcggagtttgctgttgctgacatggttgacatgtttgttttactactgccaccagcaggaggagatgagctgcagggtatcaaaaggggtataatcgagatggcagatctggtagctgtaactaaatctgatggagacttgattgtgccagctcgaaggatacaagcggaatatgtgagtgcactgaaattactccgcaaacgttcacaagtctggaaaccaaaggtaattcgtatttctgcccgaagtggagaggggatctctgaaatgtgggataaaatgaaagatttccaggacctaatgcttgccagtggggagctgactgccaaacgacggaagcaacagaaagtttggatgtggaatctcattcaggaaagtgtgttagagcatttcaggacccaccccacagtccgggaacagattccacttctggaacaaaaggttctcattggggccctgtccccaggactagcagcagacttcttgttaaaagctttaaaagcagagactaataaaattcatcctgtataataattttacatatcatttcataaagtattttaatagaaaaatcacttgtatgcttatattttcagtaattattgtatggtgctcttgtcttctttgtttgtgacccatgcttgaa

SEQ ID NO: 17942 - DNA, 1352 bp, Homo sapiens
gagccaaaacgcatccagtgttttctccagttacaaataaaacgaatatgcccatgctgctaccacatcctcaccagcatttcctaaaaggccttttaagagcacctttccgatgttaccacttcatctttcactcaagtactcatctcggatcaggaatcccatgtgctcagccgtttaattctcttggactccattgtacaaagtggatgctgctgtcagatggcttaaagagaaaattatgtgtacaaacaaccttaaaggaccacacagaaggactttctgataaagagcaaagatttgtggataaactttatactggtttaatccaagggcaaagggcctgtttagcagaggccataactcttgtagaatcaactcacagcaggaaaaaggagttagcccaggtgcttcttcagaaagtattactttaccacagagaacaagaacaatcaaataaaggaaaaccactagcatttcgagtaggattgtctgggccccctggtgctggaaaatcaacatttatagaatattttggaaaaatgcttactgagagagggcacaaattatctgtgctagctgtggacccttcttcttgtactagtggtggatcactcttaggtgataaaacccgaatgactgagttatcaagagatatgaatgcatacatcaggccatctcctactagaggaactttaggaggcgtgacaaggaccacaaatgaagctattctgttgtgtgaaggagcgggatatgacataattcttattgaaaccgttgggtatcaaaaggggtataatcgagatggcagatctggtagctgtaactaaatctgatggagacttgattgtgccagctcgaaggatacaagcggaatatgtgagtgcactgaaattactccgcaaacgttcacaagtctggaaaccaaaggtaattcgtatttctgcccgaagtggagaggggatctctgaaatgtgggataaaatgaaagatttccaggacctaatgcttgccagtggggagctgactgccaaacgacggaagcaacagaaagtttggatgtggaatctcattcaggaaagtgtgttagagcatttcaggacccaccccacagtccgggaacagattccacttctggaacaaaaggttctcattggggccctgtccccaggactagcagcagacttcttgttaaaagcttttaaaagcagagactaataaaattcatcctgtataataattttacatatcatttcataaagtattttaatagaaaaatcacttgtatgcttatattttcagtaattattgtatggtgctcttgtcttctttgtttgtgacccatgcttgaa

SEQ ID NO: 17943 - DNA, 1174 bp, Homo sapiens
aggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattggacggagtttcgcgcttgttgcccagactggagtgcaatggtgtgatctcggctcactgcaacctctgcctcccgggttcaagcgagtctcctcattattactattcttaacacttacctgttcctggctaccatttctccatggcgggcctgactaggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacatgaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtggg

SEQ ID NO: 17944 - DNA, 2725 bp, Homo sapiens
cctgccgccgccgccgcctccccggccgccgcccctccgcgccgaagccggagcagctccccaactcccacaacccagagcgcccgtgcctcaaggggaggaggcgttgtacttcaggccagccaatcagagcgcgcgagcccggagtacctttaccaataggcttgaacattggtcaataggtgttgcagccaagccgacacgggttttcccgccccgctccttccgttaaaccaatgggaaacaagtccctgggagtgtcccgccctggggtgagaactgcgaaccaataaaaattgaaacctgagcggtggcgcggccagctgtgggtggagtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacatgaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtgatttacctgtgccaaaggtgctttaaatgtcacatttgtaaaggggaaggcggacaagatttggaagtttagtcacctctgagccacccatcaccgccaaagtgtgggggaaggatagctgcagattgacaggcgaggctcagaaactcctggcttagattgaagtgtgtgtgatgggggtgcagcttagaggaccccctctgaaagggatggagatgctgatgagaacaacactaccacttgaaggtgaacattccctgtctggttggactgagtcaagggtctgcggtgcagcatcttcagcttgagaaaatgaggttgtcagtttccagcaaggctgacatccaccagactgatttctccgatgttgcacttggctggcttatgcctctgagatcggtgccacggctgtatttatttcagttgtcactgctgctccctcctgctatgaaacgacactgccagtgccagcagtgtccttgggaaaggcaatatttatgaagggcagaagaggcagccccaagaacctaaagactgcaggctgctaattgcaggaaatgactttggaagggcaggctcttgtccagtttcagggctgaaatgcctggcgaactccattcagccatcacatattgactgagtggctgcttagcatgggccaccgcgctaggctcgggacagctggtctttccggccatctttcttgctggcaagtcagcaaacattaccttcttagtcacgtgcatatttttgccttcattcttaccacctggcctgcaaagtttgcaggagggccaggtatattcacttgtgtcttctgggtcctttcattgctgacaggctgtgatggccctcttgagccttgggcagggtgggtgaggtgcagatgaccaggagtgtgtgaatgccttccaggaggtggctttgttccgtgcctccctgcccccatcgtcactaccaggtctggtacggagtcggtgctcagtgtttgcaaaacagagctgaaaacggactttgggaggccgaggcaggcagatcacctgaggtcaggagtttgagaccagcctggtcaacatggtaaaaccccatttctgctaaaaaaaaaaaaaaaaaaaaaaaa

SEQ ID NO: 17945 - DNA, 2981 bp, Homo sapiens
ggcgatggaggcggtggaactacctttctctagaagagacacgtacatgcacacccccaccgtgtagcttgccgggaaactgagtcttcctgatttcgtgtggctgtctccaaggaggaaacgaactacgcatcccaagatgcatcgcgcataggcaatatggtcccgctactggacccatttcctacctgggaaatggagtcgaagctgactcaaaacgtaacggcccaattgtccttgagacttcattccccagcaagctcagcgtgtaacgtgcgctatggagccgaaagtcgcagagctgaagcagaagatcgaggacacgctatgtccttttggcttcgaggtttaccccttccaggtggcatggtacaatgaactcttgcctccagccttccacctaccgctgccaggacctaccctggccttcctggtactcagcacgcctgccatgtttgaccgggccctcaagcccttcttgcagagctgccacctccgaatgctgactgacccagtggaccagtgtgtggcctaccatctgggccgtgttagagagagcctcccagagctgcagatagaaatcattgctgactacgaggtgcaccccaaccgacgccccaagatcctggcccagacagcagcccatgtagctggggctgcttactactaccaacgacaagatgtggaggctgacccatgggggaaccagcgcatatcaggtgtgtgcatacacccccgatttgggggctggtttgccatccgaggggtagtgctgctgccagggatagaggtgccagatctgccacccagaaaacctcatgactgtgtacctacaagagctgaccgtatcgccctactcgaaggcttcaatttccactggcgtgattggacttaccgggatgctgtgacaccccaggagcgctactcagaagagcagaaggcctacttctccactccacctgcccaacgattggccctattgggcttggctcagccctcagagaagcctagttctccctccccggaccttccctttaccacacccgcccccaagaagcctgggaatcccagcagagcccggagctggctcagccccagggtctcaccacctgcatcccctggcccttgattttctcccatgtggaccctgatttatggtggtacttgctaggacttaattggctttggcaaagcaaaaggttttgagtacaagattactatttttgataatatagtagagatcttccatgaagataacaaggctcaaggaagttaggtttggccaagataaaggccagggaaccagaattcccatctgccttcaaatgagttttttttttttttttagacagagtcttactctgtcacctaggctggagtgcagtggcacagtctctactcactgcaacctctgcctcctgggttcaagcaattatctgcctcagcctcctgagtagctgggatgacaggtgcctgccactacacctggctaattttttgtatttttagtagagatggggtttcatcatattggccaggctggtctttaactcctgacctcgtgatccacccatcttggcctcccaaagtcctgggattacaggaatgagccaccgcacccagccaagactctatctgttcccatttctaagcagttccccaagatgttgttacagggcctaaggggcaaatatcctctaaagagtacctaccagcagggtgtggtggctcccgcctgtaatcccagcactctgggaggccgaggcaggtggatcatgaggtcgagtttgagaccagcctggccaatacagtgaaaccccgtctctactaaaaatgcaaagttagccgggcatggtagcgcaggcctgtagtcccagctactcaggaggctgaggcagtagaatcatttgaaccagggaggcagagattgcagtgagccgagattgcatggctgcactctagcctgggtgacagtgtgagactctgtctcaaaaaaaaaaaaaaaagtacctacctcaggtagggactgaataaacacgtgtaaggcactttggaaaaatacctggcatatatagtaagcagtatgttggccattaccaaaggccctgggaattctgtactgctgctcatgggtgtagtcggttctagaggggtgggcaggtgggagtagctgaggaagacaagtggctggaatggtatcacatgatacacagaagtatcctcagttctgaatctaccttggcctcaagggcccaggagaataacttttcccagctgacagcctctctgaggacaatgacatatgaatgaggatcaaaacgagctttggccaggcactgtggcgctcacctgtaatcccaccattttgggaggctgaggcggaggaccgcctgaggcaaggaattcagaaccactctgggcaacataatgacactaaaaaagactatctctaatcaaggctagaaccaagggaaggctaagaattgcccagtactgtgcaactacgaaagccctacccaaggccaccagccttgtcttcctctttcctctgtcagttcaaaaagaacagaaacctccagctcttttacatagcaggtaccaggcatttatcagaagaggccaagcttctggttcccatgcagccctttgaatagtgtgtctaaacaaaaataggtgtccaagtagtcacactgagactttaactggtaacccagcctgtggcgtcagtcgcagtgctctggccaacactatagcagggcttattcttctccctcatgtgtagtgaaacaaaatgtaacaccttgggttcattcagttccattccctatatctacctgtgtcaatataattccctgatttggaggcagctctcctcattttccccaaaacagggaaagcaaggagtaaattcctcttaaaatcaaaagctaataatatgcttcctaaaataaagactcatcaaggtctcagttcaagtttaa

SEQ ID NO: 17946 - DNA, 1436 bp, Homo sapiens
gcgcgtgcgcatcatcgtttcgacgcgctcggaagcaacttcctttgcctgctcaccgccagcgtaggtgctaccaccgctgccgtcgccgccgccattttgatggcaggaagagtccggttctgggacagctggagacagtggtggtgactgaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacagacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatatttatttctaagtatttatttcagcatttatgaatttacaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaataa

SEQ ID NO: 17947 - DNA, 1726 bp, Homo sapiens
tcggtattgcccgtattttcactgggtccctgtcgttgtccccagccatcctgtccgtctgtctttagtctcttttctgcttcctcatctttccgatcagcctgaagctttgcttggagctgttgttacgcagccccaacttctgttaaagcagccgcttcgatcctctggactgaattttggccacccagcccccattcccctcccggatctggtccgagttgtttttccgcggctgtaaaccggaagggctctgagctgcactgccggctccgggctgggggatctgtgcctggcatgggggcgagttctggcctccttagggtacggggagagcttggactttggtcctgacgtggtggacgacacaccttcgaagagtggacgttacctcagttgtctgttgttagagtttaatcgatcactcgtctgttttgttgtgttctttcccagaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacagacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatatttatttctaagtatttatttcagcatttatgaatttacaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttg

SEQ ID NO: 17948 - DNA, 835 bp, Homo sapiens
ggcgggttgctttccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttctacaa

SEQ ID NO: 17949 - DNA, 3022 bp, Homo sapiens
atttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccca

SEQ ID NO: 17950 - DNA, 2261 bp, Homo sapiens
agtgagcgggcgtcgggagtgggcggatgcgttggggttcgggtcgtgggtgttgaggcggagaggaaggcgtggtgtggcgtctccaggtgattgcgattgggggaaggtagaggagccagagaacgactcagccgtttcgggggaagaggaagttggacaacatcggctgttttagtgctttttatttttccccaattcagcagagaatattttcaagggggcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccc

SEQ ID NO: 17951 - DNA, 6029 bp, Homo sapiens
ctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcgtcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatttaatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaattagctgggcgtggtggtgggcacctgtagtcccagctactcaggaggctgaggcaggagaatggtgtgaacctgggaggtggagcttgcagtgagcagagcttgcagtgagacgagcttgtgccactgcactccagcctgggcaacagagtaagactcagtctcaaaaaaaaaaaaaagagtgaaatgctttttgtttgcttcagttttttatcatggggagatctttttcctcagaattgttttcttttcactgtaggctattacaggatacttcaggatcaagatacagaaccttttatttaaagagtttgtaaagtcaatgtgtttgtttgtgtctctgagattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttagtgattaatagatttgcatgtacatagaagtctttgttggccttataatctgctgttatatttggcatggattttcatggttttgagaatgacatcctggccctgtggtccccgagggtcatggtccttgtgacctggcccctgttcactgcccccttcgctagcacgagttgctgtgcagggctggaggtagctaccatggcttgtttcaaggaaggaaactctggtacggtggcaccctcaggagtggaggacagtgaacttccttgaagagggagtgactaaggtgacctccaacctgccctgagccagctgccctgcaggtgccacgtgagcctgctctggcatccacaggatgctcctggagcctcttctctggctgctacctcagggcatggttgtggccccaccaacacctattttccaaataattattcattcttgtgacagtggcctgaacatgtttttaattttctcaacaagcatttagccagcacttatccagtgaaacaatttgataaggtttcaaggagtatctgatgggttaggaagtcacgaaatgaggagttcttgccacatttgcagagtccctccttgataaggtttggcggtgtccccacccaaatctcatgttgaattgtagttcccataatccccacatgttgtgggagggacccagtgggaggtaattaaatcatgggggtggttacccccacactgctgttctcatgatactgagttctcacaagtcctgtttgttttataaggggcttttcccccttttgctcaacacttcttcctgccatcatgtgaagaaggacgtgtttgtttccccttctgccacgattgtaagtttcctgaggccttcccagctatgtggaactgtgagttaattaaacctctttcctttataaattacccagtcatgggcagtcctttacagcagcatgagaatggactaatacactcctcaaatgttttgaagattgttgcaccttggaactaccagtgtgcacacaatctggctcaatgtatatattggcccagcaaggcaaagaactgaagttccaggatggaagaacctgtgttctcctcataatagtatagaataattcaagataggcaagaaggacagcagtaaatgaagaccatggaagaaaagaaggaatgccaaagatcgaggaaatctaccaagactagtagggtagtccagaagaagctgtttcagggcctgttgccagctatgcctttgagaacctcgggatcccaaagaatgaggggaatttcttcagaaagacaatctcggcatgcattatttctttgttttgaagattcactcatgttgcatgcatctgtagcttgtgccttttttattgcctagtagtattctgtcatatgcctatcttacaatttgattatctattcacctgttgatgaatgtttgaattttttccatttgaggaattttatgaataaagctgctataagcatgaaattacaagtctttttgtgaacatattttcacttgtgcaaatgcctatactcccaccagtaatttgtaagaattcttgacaaagcttggtattgtcagcgtttttaattttagccattctattgggtatattttgatatctcgtggttttgatttgcatttttctgattaaagatgttgaacttcttttcatgtgcttattggccattcacatatttcgtgaactatctgtacaaatatttttgtttattaaaaaattagattgttttgttttattattgaatagtaagaattgtttatatattctggatacactctttttcagatatgtgtgttgtgactattcttagtctttagcttgccttttcattttcttaattatgtctttcaaagaacaagtttttcattttgacgaagcctagtttatcaattttttttatggttggtgctttttgtgtgttccaagaaatctttgcctactcatttaattacctgtgtgcccttgtcaaaatcatttaattttgactactcacttaattaccttgcctactcatttaattacctgtgtgcccttgtcaaaatttactgtttatctgtgaatctggatgatctatttatgtcatttatctatgtgtctcttcttatgccagtaccccactgtcttgattattgtggctttatggtgtcttgaaattaagtattgttaagctttgcaatcttttccaagattgttttggctataggtcctttctttataaagtttatattaagcttctccatttttctttaagaaaaaatctgctggaatggcactgaatttttaggtcgatttgggaagaattgacaatattgaacctttcaatcgatggacatggtatgtttctgcatttatttgggccttttaaaatttatctcagcaatattttgtagttttagtgaagaagtcttgtatatatcttttgttaaatgtattcctaaatattttgtggaaatgttactgtaaatagtactttaatttcatttttaagtttattgctggtatacagaaatatgttttatttttgtatattgactttatattctgtaatcttattaaattcacttagttca

SEQ ID NO: 17952 - DNA, 1096 bp, Homo sapiens
cacgtggatttggtagagaaaccccggactgggatcatggcagccgagactcggaacgtggccggagcagaggccccaccgccccagaagcgctactaccggcaacgtgctcactccaaccccatggcggaccacacgctgcgctaccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacaca

SEQ ID NO: 17953 - DNA, 2066 bp, Homo sapiens
aaagagcccgacctcccgcgggaacaccgattccgactcagattcgggatctgggccggggtccgccatccggcccgccaagggagtgcctgggcaccgcggccggcgctcagatcccggatccggagcggggtagaggctgggggccgcgagccgtcgtggtgtccctgtggaacgagccccgcctccctgagtttgccctccttcctccagttcgatttcctggaggtggaatgaggagctgcccctcccgccccggccccgagcgcacactcgacgaaacccacacgggaccacaagagtcagaccgggcggactggtccgagaccaggagtaaggggacaggagcgaggactgatgccactgtagaaggcgaggtctctagacccctctcacctgtggggtgcacaggtgcctgcaaccaggatggtaacccagaccaggcagaagcaagctaagagaaaacgttgggtccctgggcctggcctcgccctcccagttggaggctaacggtgcggaggttccctccagcactcgctccttacagccctccccacctagcccagcccagcccagcccagcccagctgaatttgctcttgggtctttaaggggcgggaactgccaccaacgcgcatggctgcgtcattaacttgcgcctctggcctgcgcctccacgtggatttggtagagaaaccccggactgggatcatggcagccgagactcggaacgtggccggagcagaggccccaccgccccagaagcgctactaccggcaacgtgctcactccaaccccatggcggaccacacgctgcgctaccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccctaa

SEQ ID NO: 17954 - DNA, 2799 bp, Homo sapiens
atggctgaggtgggccgtaccgggatcagctacccaggcgcgcttctcccacagggcttctgggctgcggtcgaagtgtggctggagaggccgcaggtggcaaacaaacggctttgcggcgcccgcctggaggcccgctggagcgccgccctgccctgcgcggaggcccgcggccccgggactagcgcaggctcggagcagaaggagcggggtccgggacccggccagggttcccccggagggggcccgggtcccaggtcgctatcaggacccgagcagggcacggcatgttgcgaacttgaggaggcccagggccagtgccagcaagaggaggcacagagggaagccgcctcagtgcccctgagggactccgggcaccccggccatgctgaaggaagggagggcgacttccccgccgcagatctggattcgctttgggaggatttctcccaaagtctcgcccgtggcaattcggagttgctggccttcctcaccagctccggggcgggatcgcagccagaggcgcagcgtgagctcgacgtggttctcagaaccgtcatcccgaaaactagcccacattgcccccttacaactcccaggagggaaatagtcgtgcaagatgtcctcaatggaaccataacgtttttgcctttggaagaagatgatgaggggaacctaaaggttaagatgagcaatgtgtatcaaattcagctcagtcatagcaaagaagaatggttcatatctgttttaattttctgtccagaaagatggcattcagatggaatcgtgtatcccaaacccacgtggcttggagaagagttgctggccaagttggccaagtggtctgtagagaacaagaagagtgactttaaaagcaccctttccctcatctccattatgaagtatagcaaggcttaccaggaacttaaagagaagtataaggaaatggttaaggtgtggcctgaagtcactgatcctgagaagttcgtgtatgaagatgtggctatcgcagcatacctgctgattctatgggaagaagaaagggctgagaggagactaactgccaggcagtcctttgtggacctgggatgtggaaatggcctcctggtccacatcctgagcagtgaggggcatccaggcagagggattgatgtccgaagaagaaaaatctgggacatgtatggaccacaaactcagttagaggaagatgcaatcacacccaatgataagacccttttccctgatgttgattggttaatcggtaaccattctgatgaactcacaccatggatacctgtcattgcagccaggtcttcctacaattgccgcttctttgtcctcccctgctgcttctttgacttcattggaagatactcccggaggcagagtaagaagactcagtaccgggaataccttgacttcattaaagaagtgggcttcacctgtgggtttcacgtggacgaagactgcctcaggattccttcaaccaaaagagtctgtctcgttggaaaatccagaacatacccttcctccagagaagcttccgtggatgaaaagaggactcagtacattaagagcaggcggggctgccctgtaagcccacctggctgggagctttccccttctccacgctgggttgctgctggcagtgctggtcactgtgacggtcagcaagctctggacgccagggtcgggtgtgtaaccagggcctgggccgctgagcatggagcagggccccaggctgaaggaccctggctacctggatttcatcccagagaaaaggctgagcgtgtgaggaactgtgccgccctgccacgagattttattgaccaagtggttttgcaagtagcgaatttactgttaggtggaaagcaattaaacacaagaagttctcgaaatgggagtttgaagacctggaatgggggagagagcctatctctggcagaagtagccaacgagctggacacggagaccctgcggaggctgaagcgggagtgtgggggcctgcagacgctgctccggaacagccaccaggtgttccaagttgtgaatgggagagttcacatccgcgactggcgagaggagacactgtggaagacaaagcaaccggaagcgaaacagagactgctctctgaagcctgcaaaacccgcctctgctggttcttcatgcatcaccctgatggctgcgctctgtccacggactgctgcccgtttgcccatgggcctgcggagctgcggccaccccggaccaccccgaggaagaagatttcatgagctgcatccttgccagccgaggcctggttggggaggccaaaccaaggagagcttccccagcagtcgtcagtgctgtggtctctgctctggctgtgtttcagcccacctcctcccagctttctccacatcctcacagtgatgaaccgtatttcataaacatcacacgccagagaagccacagttactcggaagcccccagctgactgcctggcttgtttcagatgcagccgcttgaaacgtgcgcagcatcttcatatcataaagattgtgcacggatccttacaatgtctcctgggggagagcggctgaggctgccttgcacaggcccttcccagggcgctgtccgacgcctgccccaccatgtccacatctgtgaagaggatggggctcctcgagaagtaagaccgtatctgccagcgtttctcaccacactggagagcagctgctctggagcagggatccaccagattggtatttttaaaaaaggtgtcaggcttgctatgttgaggttgtttttagagttac

SEQ ID NO: 17955 - DNA, 1666 bp, Homo sapiens
gattcggagacgagaccaagctgttgctgaggacgacagccctgctctggtcactccggaggctgaccagtctacacacggctgaagcttgaagaaacaacaagcccggctctagtcacgcactggcagctgaatagtctacgcatggccgaagcttgaggacttgtcaagcaaatgtcctcaatggaaccataacgtttttgcctttggaagaagatgatgaggggaacctaaaggttaagatgagcaatgtgtatcaaattcagctcagtcatagcaaagaagaatgaaagatggcattcagatggaatcgtgtatcccaaacccacgtggcttggagaagagttgctggccaagttggccaagtggtctgtagagaacaagaagagtgactttaaaagcaccctttccctcatctccattatgaagtatagcaaggcttaccaggaacttaaagagaagtataaggaaatggttaaggtgtggcctgaagtcactgatcctgagaagttcgtgtatgaagatgtggctatcgcagcatacctgctgattctatgggaagaagaaagggctgagaggagactaactgccaggcagtcctttgtggacctgggatgtggaaatggcctcctggtccacatcctgagcagtgaggggcatccaggcagagggattgatgtccgaagaagaaaaatctgggacatgtatggaccacaaactcagttagaggaagatgcaatcacacccaatgataagacccttttccctgatgttgattggttaatcggtaaccattctgatgaactcacaccatggatacctgtcattgcagccaggtcttcctacaattgccgcttctttgtcctcccctgctgcttctttgacttcattggaagatactcccggaggcagagtaagaagactcagtaccgggaataccttgacttcattaaagaagtgggcttcacctgtgggtttcacgtggacgaagactgcctcaggattccttcaaccaaaagagtctgtctcgttggaaaatccagaacatacccttcctccagagaagcttccgtggatgaaaagaggactcagtacattaagagcaggcggggctgccctgtaagcccacctggctgggagctttccccttctccacgctgggttgctgctggcagtgctggtcactgtgacggtcagcaagctctggacgccagggtcgggtgtgtaaccagggcctgggccgctgagcatggagcagggccccaggctgaaggaccctggctacctggatttcatcccagagaaaaggctgagcgtgtgaggaactgtgccgccctgccacgagattttattgaccaagtggttttgcaagtagcgaatttactgttaggtggaaagcaattaaacacaagaagttctcgaaatgggagtttgaagacctggaatgggggaggtaagctgtccaccatcttagggaggggctagcacgctcccaggcttgagggcaggaattcacgtcttcagaaccgacatgaaatggtgtggccctgtgactacacactttgaaaaagccattgatggtgggtgcataggctctcttcaagcaaattctttaaaattttccaaatagctcttataaacataaaggactttgttatttccaggg

SEQ ID NO: 17956 - DNA, 2015 bp, Homo sapiens
aaatgacttttctgtcttgctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagttggga

SEQ ID NO: 17957 - DNA, 562 bp, Homo sapiens
ttttccggttagccttcggggtgtccgcgtgagaattggctatatcctggagcgagtgctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaa

SEQ ID NO: 17958 - DNA, 925 bp, Homo sapiens
attttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggc

SEQ ID NO: 17959 - DNA, 1952 bp, Homo sapiens
tggggagctgctccggcttcggcgcggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaac

SEQ ID NO: 17960 - DNA, 1770 bp, Homo sapiens
ggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaa

SEQ ID NO: 17961 - DNA, 834 bp, Homo sapiens
cgcggtgacctcacggcggtgtgacgtacccatggcgacgacaccacgattcacggcaggtgttcgagttgcccttcccgccagccactcacctgtccccgtcttccacgccctgagggccgcggctctggaaacggggatacaggagcctggcggcgccgaagcacccgcgcaggccaagacggctccccaggccaagacggctccccaggccgcacacagccatgagccaggctgcttgacgggacctgaccccgccaggttcccgtccagtccgcggggtgactccacccacagctggccgcgccaccgctcaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacgg

SEQ ID NO: 17962 - DNA, 1095 bp, Homo sapiens
aggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctg

SEQ ID NO: 17963 - DNA, 1075 bp, Homo sapiens
aggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctgggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacct

SEQ ID NO: 17964 - DNA, 886 bp, Homo sapiens
gattcacggcaggtgttcgagttgcccttcccgccagccactcacctgtccccgtcttccacgccctgagggccgcggctctggaaacggggatacaggagcctggcggcgccgaagcacccgcgcaggccaagacggctccccaggccaagacggctccccaggccgcacacagccatgagccaggctgcttgacgggacctgaccccgccaggttcccgtccagtccgcggggtgactccacccacagctggccgcgccaccgctcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctc

SEQ ID NO: 17965 - DNA, 1648 bp, Homo sapiens
atgcctagtctagtggtatctggaataatggaaagaaatgggggctttggagaactaggatgtttcgggggaagcgctaaggaccgagggctgctggaagacgagcgcgcccttcagctggctctcgatcaactctgcctcctgggtttgggggagccccccgcccccacggcgggcgaggacgggggaggtggggggggcggcgcccccgcgcagccggccgcccccccgcagccggccccgccgccgccgcccgcggcgcccccggccgccccgacggcggcccccgcagcgcagacgccccagccccccaccgcccccaaaggggcgagcgacgccaagctctgcgctctctacaaagaggccgagctgcgcctgaagggcagcagcaacaccacggagtgtgttcccgtgcccacctccgagcacgtggccgagatcgtgggcaggcaaggctgcaagattaaggccttgagggccaagaccaacacctacatcaagacaccggtgaggggcgaggaaccagtgttcatggtgacagggcgacgggaggacgtggccacagcccggcgggaaatcatctcagcagcggagcacttctccatgatccgtgcctcccgcaacaagtcaggcgccgcctttggtgtggctcctgctctgcccggccaggtgaccatccgtgtgcgggtgccctaccgcgtggtggggctggtggtgggccccaaaggggcaaccatcaagcgcatccagcagcaaaccaacacatacattatcacaccaagccgtgaccgcgaccccgtgttcgagatcacgggtgccccaggcaacgtggagcgtgcgcgcgaggagatcgagacgcacatcgcggtgcgcactggcaagatcctcgagtacaacaatgaaaacgacttcctggcggggagccccgacgcagcaatcgatagccgctactccgacgcctggcgggtgcaccagcccggctgcaagcccctctccaccttccggcagaacagcctgggctgcatcggcgagtgcggagtggactctggctttgaggccccacgcctgggtgagcagggcggggactttggctacggcgggtacctctttccgggctatggcgtgggcaagcaggatgtgtactacggcgtggccgagactagccccccgctgtgggcgggccaggagaacgccacgcccacctccgtgctcttctcctctgcctcctcctcctcctcctcttccgccaaggcccgcgctgggcccccgggcgcacaccgctcccctgccacttccgcgggacccgagctggccggactcccgaggcgccccccgggagagccgctccagggcttctctaaacttggtgggggcggcctgcggagccccggcggcgggcgggattgcatggtctgctttgagagcgaagtgactgccgcccttgtgccctgcggacacaacctgttctgcatggagtgtgcagtacgcatctgcgagaggacggacccagagtgtcccgtctgccacatcacagccacgcaagccatccgaatattctcctaagccccgtgccccatgcctccggggcccactccactgggcccaccctggacctgttttccactaaagccttttggaaagcggtgat

SEQ ID NO: 17966 - DNA, 3528 bp, Homo sapiens
tcaagaggcggggaggagaggaggaaaaagcgctgagtgagggcgggcgggcgggcgggagggagggagtggaggagccggggaggggctccttaaagaaacgcttctgtcgctcgcctgctcgcttttcgctcggcattgcggccagccagccgggcactcggggggcacgcgcggccaccgctagagctctgcccccaccccacccgccagcaggtctggggtggggacccaggtgggggctcctgcagccactgcccggtgcggaccgcacggagcgacccactcctcccagcaccgaggaagaagcaacggagccctcagcaggcgaccggcctccccgcccctgaccacccgcttcccggctgcctttgtggccgcagcttctcgccgccgagccgagggccggcgggggcgcggcgcgcacggccgagcgatgcccagctcgctgttcgcagacctggagcgcaacggcagcggcggcggcggcggcggcagcagcggagggggagagaccctggatgaccaaagagccctgcagctcgcgctcgaccagctctccctgctggggctggacagtgacgagggcgcctctctgtacgacagcgagccgcgcaagaagagcgtgaacatgaccgagtgcgtgccagtacccagttctgagcatgtcgccgagatcgtggggcggcaaggttgtaaaatcaaagcgctgcgggcgaagaccaatacttacatcaagaccccagttcgcggggaggagcctgtctttgttgtgacgggcaggaaggaggatgtggccatggctcggagggagatcatctctgctgccgagcacttctccatgatccgcgcctcccggaataagaacacggcactcaacggcgcggtgcctgggccgcccaacctgcccgggcagaccaccatccaagtgcgggtaccctaccgcgtggtggggctcgtggtggggcccaaaggcgccacaatcaagcgcatccagcagcagacgcacacgtacatcgtgacgcccagccgggataaggagccggtgttcgaggtgaccggcatgccagagaacgtggatcgcgctcgagaggagattgaggcgcacattgctctgcgtaccggcggcatcattgagctcacagacgagaacgacttccacgccaacggcaccgatgtgggcttcgatctgcatcatgggtccggcgggtccggcccaggcagcctctggagcaagcccacccccagcatcacgcccacccccggccgcaagcctttctctagctaccgcaacgacagctccagctcgcttggcagtgcttccacagactcttatttcggcggcgggaccagcagcagcgcagcggctacccagcgcctggcggactacagcccccctagccccgccctgagctttgcgcacaacggaaacaataacaataacggcaatgggtacacctacacagcggggggagaagcctcagtgccatcccccgacggctgccccgagctgcagcccacttttgacccggctcccgctcccccacctggggcaccacttatctgggcccagttcgagcggtccccgggaggcggacctgcagctccggtatcttcttcctgctcttcttctgcatcttcgtctgcttcttcctcctccgtggtcttccccgggggtggcgccagtgcgccctccaacgccaacctggggctattggtgcaccgccggctgcaccctggcaccagctgcccgcgcctgtctccacccttgcacatggccccgggggcgggagagcaccacctggctcgccgggtgcgcagcgacccgggtggaggaggcctggcctacgccgcttatgccaacgggctgggggcacagctgcctggcttgcagccgtcggacacgtcgggctcctcctcttcgtccagctcctcctccagctcttcatcctcttcctccgggcttcggcgtaaaggcagccgcgactgctccgtgtgcttcgagagcgaagtgattgccgcgctggtgccctgtggccacaacctcttctgcatggagtgcgccaatcgcatctgtgagaagagcgagcccgagtgcccggtctgccacaccgcggtcactcaggccatccgcatcttttcttaaaggcagcgggcgctgctagtgcgcaccgtgctgggggaagggggaacccctccccaccctctttccccagcgctcgcctgcctccctgggtgccccccctctcccttctccttcccggccccaccaacactctgagatccgagaggagcttggaaagctgtagtatccgctcatttttaaaatttaatttttaagtaaaggaatttgccaggatatctgcatcaagagtactgtagcctgggaaacctgaacacctgaaatgcatgctctataaataataggaacggcgacattctagtaatgatagtttttacactgtacttaataggaagcttccaaaagaagaaaaccccacaagttttccattttcttaaagtaggaaaaaatgaacagtaataattatgatgaagatgatagtagtgctatgggatgtgtggactgtttagtgtgttcccctttgtgggtgggttcctatgatacttattatagaacacagtggatcctttttgaatgttcgtggaagggccaggagttcctgtgaaaccaggatactgcagctttattaaagttaaagaaactgtaacatatctcttatatattaaaaacgtttaaaagttttaaagagaaattgcattaatacagattgaagtattttattcttttttgacttgaaaaattatatttcatattgcaaagatgtttacaagtattttaatttaagttcagtgaacttttttgtagctgggttaaatctttttattttagtatggccttatggcaaagaacactgtattattttaataatcacacaattgtgacggaattacaaccataaaatgtgtaatgttttgaacagtattctgttgggatggagattttataggttcagacaaatcttctagatctgcttcacccagcatattttctattcagtgatataaagcatattttattctatattattacaaaaacggaaatgtataaacatgtcaaaaagaactgttgatgctttctaacatttgtataaatagaattcagtgcaagttacaaaaattctgttgcaccactctagttttagtatttctattttaatacatttgtttaccacttgtttatgtatatgtaggtgatgttacttgagcttaaatgtactttactgagcaaagtttaaaaaacaaagtatattttattttatgataaagggcctttaacctcatggtcaaatactaatattatatttgctgagacaagatttgaaattgtatcaagagttttatttttctgacatttaaagttctacataataaaggtaaaacttaagtaatggtgctacttcattttttaagtatttctatataaataaaatattgaagaaaatctta

SEQ ID NO: 17967 - DNA, 3781 bp, Homo sapiens
atgcccagcggcagctccgcggccctggccctggcggcggccccggcccccctgccgcagccgcccccgccgccgccgccgccaccgccgcctctgccgccgccctcgggcggcccggagctcgagggggacgggctcctgctgagggagcgcttggccgcgctaggcctcgacgaccccagcccggcggagcccggcgccccggcgcttcgggccccggcagcggcggcgcagggccaggcccggcgggcggcggagctgtctccagaggagcgggctccgcccggccggcccggggccccggaggcggccgagctggagctggaagaggacgaggaggagggggaggaagcggagctggacggagacctgctggaggaggaggagctggaggaagcagaggaggaggaccggtcgtcgctgctgctgctgtcgccgcccgcggccaccgcctctcagacccagcagatcccgggcgggtccctggggtctgtgctgctgccagccgccaggttcgatgcccgggaggcggcggccgcggcggcggcggcgggggtgctgtacggaggggacgatgcccagggcatgatggcggcgatgctgtcccacgcctacggccccggcggttgtggggcggcggcggccgccctgaacggggagcaggcggccctgctccggagaaagagcgtcaacaccaccgagtgcgtcccggtgcccagctccgagcacgtcgccgagatcgtcggccgccagggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccatttgaaccagttaacccactctctggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaacttgaa

SEQ ID NO: 17968 - DNA, 2332 bp, Homo sapiens
tggcgctggaccagctgtcggcgctcgggctggggggcgctggcgacacggacgaggagggggcggccggggacgccgccgccgccccggccgtcgccccccgacgtgttcgcgggcttcgcgccccaccccgcggccctggggcccccgacgctgctggccgaccagatgagcgtgatcggcagccgcaagaaaagcgtcaacatgaccgagtgcgtcccggtgcccagctccgagcacgtcgccgagatcgtgggtcgccagggctgcaagatcaaggccctgcgggccaagacaaacacctacatcaagaccccagtgcggggcgaggagccggtcttcatcgtgaccggccggaaggaggacgtggagatggccaagcgtgagatcctgtcggcggccgaacacttctccatcatccgcgccacgcgcagcaaggccgggggtctgcccggcgccgcccagggcccgcccaaccttcccggacagaccaccatccaggtgcgcgtgccctaccgggtggtggggctggtggtggggcccaagggcgccaccatcaagcgcatccagcagcggacgcacacctacatcgtgacgcccgggcgcgacaaggagccggtgttcgcggtcactgggatgcccgagaacgtggaccgcgcgcgcgaggagatcgaggcgcacatcacgctgcgcactggcgccttcaccgacgcgggccccgacagcgacttccacgccaacggcaccgacgtctgcctggacctgctcggggcggccgccagcctctgggccaagacccccaaccagggacgacggccccccacggccacggccggcctccgcggggacacggccctgggcgcccccagcgcccccgaggccttctacgcgggcagccgcggcggcccctccgtgccggacccaggccccgccagcccctacagcggctccggcaacgggggcttcgccttcggcgcggagggtcccggtgccccggtggggacggccgcccccgacgactgcgacttcggcttcgacttcgacttcctggcgctggacctgaccgtgcccgccgcggccaccatctgggcgccttttgagcgcgccgcccccttgcccgccttcagcggctgctccacggtcaacggagccccgggacctcccgccgccggcgcccggcgcagcagtggggccgggaccccccgccactcgcccacgctgcccgagcccggcggcctccgcctggagctcccgctgtctcgccgtggcgccccggacccggtgggcgcgctgtcctggcgacccccgcagggccccgtatccttcccaggcggcgccgccttctccacggccacctcgctgcccagcagccccgcggccgccgcctgcgcccccctggactccggcgcctccgagaacagccgcaagcccccttcggcgtcctcggccccggccctggcgcgagagtgcgtggtgtgcgccgagggcgaggtgatggctgcgctggtcccctgcggccacaacctcttctgcatggactgcgccgtccgcatctgcggcaagagcgagcccgagtgtcccgcctgccgcacgccggccacccaggccattcgcgtggagacggagaccccgcagcccggcggcgcctcagcccttcaacgacagtattgagtggtcaggttacaataaaccggagagaaaaggtccgcttgcactttttttagttttcttatttttagacacccctcccctccagggtgatctttaaaaaagcaaaacaaaaaacacgacttttccagcgctcagcgttttttcctttcgtccgaagccgttttctgatttgacttttctcgccggccggtctcaggccgcacagacgttccagaggaggagggtgacatttttactccctttttggggctaaccatttatgcttttgtacatcaaccgtgcgcggccggagggggcaggggggcgggggcgaggggcgttccaatcaaatttctaactttctgttaattattaatcccctttttactgcggtttctgttgtcatttttaaaatttttttaatttttttttttttttacttttactttttacctcttgtgtatatgtagggaatttatagggaaatatgtactttatggaataaattttaagaactaaaatatattttattttaaataaagtaatggacctttaatcttacacagctaaattactgattatatatttgctgagctgatttaagggttaaaaaaattgtatcaagagttttattttttgacttcaaagccttcttaataaagcctcttttctacatgtgagc

SEQ ID NO: 17969 - DNA, 2660 bp, Homo sapiens
atgcccagctcgctcggccagcccgacggcggcgggggcgggggcggcggcggcggcggcgtgggggcggcgggggaggaccccggacccggacctgcgcccccgcccgagggcgcccaggaggccgcgcccgcgccccggccgccgcccgaacccgacgacgcggccgccgcgctccgcctggcgctggaccagctgtcggcgctcgggctggggggcgctggcgacacggacgaggagggggcggccggggacggcgcagcggcggcggggggcgcggacggcggggcggctccggagcctgtgccccccgacggacctgaggccggcgcgcccccgaccctggcccccgccgtggcccccgggtcgctgccgctgctggaccccaacgcgagtcccccgccgccgccgccgccccggccgtcgccccccgacgtgttcgcgggcttcgcgccccaccccgcggccctggggcccccgacgctgctggccgaccagatgagcgtgatcggcagccgcaagaaaagcgtcaacatgaccgagtgcgtcccggtgcccagctccgagcacgtcgccgagatcgtgggtcgccagggctgcaagatcaaggccctgcgggccaagacaaacacctacatcaagaccccagtgcggggcgaggagccggtcttcatcgtgaccggccggaaggaggacgtggagatggccaagcgtgagatcctgtcggcggccgaacacttctccatcatccgcgccacgcgcagcaaggccgggggtctgcccggcgccgcccagggcccgcccaaccttcccggacagaccaccatccaggtgcgcgtgccctaccgggtggtggggctggtggtggggcccaagggcgccaccatcaagcgcatccagcagcggacgcacacctacatcgtgacgcccgggcgcgacaaggagccggtgttcgcggtcactgggatgcccgagaacgtggaccgcgcgcgcgaggagatcgaggcgcacatcacgctgcgcactggcgccttcaccgacgcgggccccgacagcgacttccacgccaacggcaccgacgtctgcctggacctgctcggggcggccgccagcctctgggccaagacccccaaccagggacgacggccccccacggccacggccggcctccgcggggacacggccctgggcgcccccagcgcccccgaggccttctacgcgggcagccgcggcggcccctccgtgccggacccaggccccgccagcccctacagcggctccggcaacgggggcttcgccttcggcgcggagggtcccggtgccccggtggggacggccgcccccgacgactgcgacttcggcttcgacttcgacttcctggcgctggacctgaccgtgcccgccgcggccaccatctgggcgccttttgagcgcgccgcccccttgcccgccttcagcggctgctccacggtcaacggagccccgggacctcccgccgccggcgcccggcgcagcagtggggccgggaccccccgccactcgcccacgctgcccgagcccggcggcctccgcctggagctcccgctgtctcgccgtggcgccccggacccggtgggcgcgctgtcctggcgacccccgcagggccccgtatccttcccaggcggcgccgccttctccacggccacctcgctgcccagcagccccgcggccgccgcctgcgcccccctggactccggcgcctccgagaacagccgcaagcccccttcggcgtcctcggccccggccctggcgcgagagtgcgtggtgtgcgccgagggcgaggtgatggctgcgctggtcccctgcggccacaacctcttctgcatggactgcgccgtccgcatctgcggcaagagcgagcccgagtgtcccgcctgccgcacgccggccacccaggccattcgcgtggagacggagaccccgcagcccggcggcgcctcagcccttcaacgacagtattgagtggtcaggttacaataaaccggagagaaaaggtccgcttgcactttttttagttttcttatttttagacacccctcccctccagggtgatctttaaaaaagcaaaacaaaaaacacgacttttccagcgctcagcgttttttcctttcgtccgaagccgttttctgatttgacttttctcgccggccggtctcaggccgcacagacgttccagaggaggagggtgacatttttactccctttttggggctaaccatttatgcttttgtacatcaaccgtgcgcggccggagggggcaggggggcgggggcgaggggcgttccaatcaaatttctaactttctgttaattattaatcccctttttactgcggtttctgttgtcatttttaaaatttttttaatttttttttttttttacttttactttttacctcttgtgtatatgtagggaatttatagggaaatatgtactttatggaataaattttaagaactaaaatatattttattttaaataaagtaatggacctttaatcttacacagctaaattactgattatatatttgctgagctgatttaagggttaaaaaaattgtatcaagagttttattttttgacttcaaagccttcttaataaagcctcttttctacatgtga

SEQ ID NO: 17970 - DNA, 2847 bp, Homo sapiens
atgcccagctcgctcggccagcccgacggcggcgggggcgggggcggcggcggcggcggcgtgggggcggcgggggaggaccccggacccggacctgcgcccccgcccgagggcgcccaggaggccgcgcccgcgccccggccgccgcccgaacccgacgacgcggccgccgcgctccgcctggcgctggaccagctgtcggcgctcgggctggggggcgctggcgacacggacgaggagggggcggccggggacggcgcagcggcggcggggggcgcggacggcggggcggctccggagcctgtgccccccgacggacctgaggccggcgcgcccccgaccctggcccccgccgtggcccccgggtcgctgccgctgctggaccccaacgcgagtcccccgccgccgccgccgccccggccgtcgccccccgacgtgttcgcgggcttcgcgccccaccccgcggccctggggcccccgacgctgctggccgaccagatgagcgtgatcggcagccgcaagaaaagcgtcaacatgaccgagtgcgtcccggtgcccagctccgagcacgtcgccgagatcgtgggtcgccagggctgcaagatcaaggccctgcgggccaagacaaacacctacatcaagaccccagtgcggggcgaggagccggtcttcatcgtgaccggccggaaggaggacgtggagatggccaagcgtgagatcctgtcggcggccgaacacttctccatcatccgcgccacgcgcagcaaggccgggggtctgcccggcgccgcccagggcccgcccaaccttcccggacagaccaccatccaggtgcgcgtgccctaccgggtggtggggctggtggtggggcccaagggcgccaccatcaagcgcatccagcagcggacgcacacctacatcgtgacgcccgggcgcgacaaggagccggtgttcgcggtcactgggatgcccgagaacgtggaccgcgcgcgcgaggagatcgaggcgcacatcacgctgcgcactggcgccttcaccgacgcgggccccgacagcgacttccacgccaacggcaccgacgtctgcctggacctgctcggggcggccgccagcctctgggccaagacccccaaccagggacgacggccccccacggccacggccggcctccgcggggacacggccctgggcgcccccagcgcccccgaggccttctacgcgggcagccgcggcggcccctccgtgccggacccaggccccgccagcccctacagcggctccggcaacgggggcttcgccttcggcgcggagggtcccggtgccccggtggggacggccgcccccgacgactgcgacttcggcttcgacttcgacttcctggcgctggacctgaccgtgcccgccgcggccaccatctgggcgccttttgagcgcgccgcccccttgcccgccttcagcggctgctccacggtcaacggagccccgggacctcccgccgccggcgcccggcgcagcagtggggccgggaccccccgccactcgcccacgctgcccgagcccggcggcctccgcctggagctcccgctgtctcgccgtggcgccccggacccggtgggcgcgctgtcctggcgacccccgcagggccccgtatccttcccaggcggcgccgccttctccacggccacctcgctgcccagcagccccgcggccgccgcctgcgcccccctggactccggcgcctccgagaacagccgcaagcccccttcggcgtcctcggccccggccctggcgcgagagtgcgtggtgtgcgccgagggcgaggtgatggctgcgctggtcccctgcggccacaacctcttctgcatggactgcgccgtccgcatctgcggcaagagcgagcccgagtgtcccgcctgccgcacgccggccacccaggccattcatatcttttcctagagcgcggaccaccacgtggccggggccatctgcgggggccaggggtgggcgcgggagacggggcgggacccggggtgggagagggacggggagggggcgaggggcggaggccgagggggcaggggggtgggcggcggccagtgtttacagatgagctttaactgccgcctcaggcgtggagacggagaccccgcagcccggcggcgcctcagcccttcaacgacagtattgagtggtcaggttacaataaaccggagagaaaaggtccgcttgcactttttttagttttcttatttttagacacccctcccctccagggtgatctttaaaaaagcaaaacaaaaaacacgacttttccagcgctcagcgttttttcctttcgtccgaagccgttttctgatttgacttttctcgccggccggtctcaggccgcacagacgttccagaggaggagggtgacatttttactccctttttggggctaaccatttatgcttttgtacatcaaccgtgcgcggccggagggggcaggggggcgggggcgaggggcgttccaatcaaatttctaactttctgttaattattaatcccctttttactgcggtttctgttgtcatttttaaaatttttttaatttttttttttttttacttttactttttacctcttgtgtatatgtagggaatttatagggaaatatgtactttatggaataaattttaagaactaaaatatattttattttaaataaagtaatggacctttaatcttacacagctaaattactgattatatatttgctgagctgatttaagggttaaaaaaattgtatcaagagttttattttttgacttcaaagccttcttaataaagcctcttttctacatgtga

SEQ ID NO: 17971 - DNA, 2088 bp, Homo sapiens
gcaggccggacagcgggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctgaagggacatgggtggaatgatggcagaatccagggtctgcagcacctgctgttgttgccaaccagtctcccaaagctccttgctccccaccccttgcgaacaggaccagattttgtttggagcctcagcatgccggggcccagatgatggagcataacgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtc

SEQ ID NO: 17972 - DNA, 2034 bp, Homo sapiens
gggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacaggtgacaaggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctgaagggacatgggtggaatgatggcagaatccagggtctgcagcacctgctgttgttgccaaccagtctcccaaagctccttgctccccaccccttgcgaacaggaccagattttgtttggagcctcagcatgccggggcccagatgatggagcataacgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtctc

SEQ ID NO: 17973 - DNA, 570 bp, Homo sapiens
gacagcgggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccctgactcctcctcacttctccagggtcccaccttgtggtcacca

SEQ ID NO: 17974 - DNA, 644 bp, Homo sapiens
gaacagatgacaacgcctgcctcgtgaggtttgagggtcgttgcgggcaagtgcatgtccaatctgggagagccggactgggttgtgaggcagcatttccgagatggcttgcacagggggtttgtgtggctgtgaagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcac

SEQ ID NO: 17975 - DNA, 524 bp, Homo sapiens
tttcctgtcttatctccatcaccgcggtggtgcccttgccccggatgaggaaactgaggccagagagaggaagtgctggctggcgtggtgtcacgcagaaggcctgaggggacagagcccagtgggacctagaaccttgctcctggttgggtgcttttctcccctgctgagacttgggaacccttttccccatctgcacggggcaggagtgtctggaccgggcctgagctggttaactgcagcgctgggcgcccgcctggctggttaagggcggtcgggtggcagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgt

SEQ ID NO: 17976 - DNA, 570 bp, Homo sapiens
actcccacctggagaccctgcagctgctgaggactgcacagctcccagaacagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctga

SEQ ID NO: 17977 - DNA, 1735 bp, Homo sapiens
gtcgcctctgtgctcgctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtctttctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 17978 - DNA, 2070 bp, Homo sapiens
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagagagccggattccagatcacgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 17979 - DNA, 2221 bp, Homo sapiens
agcggtcgggggaccgggccaggtgactaagtttccgcggcgccttctccccggccactgcttgagccgctgagagggtggcgacgtcggggccatggggctgggcccggtctttctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaagacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcagcctcccaaagtgctgggattacaagcatgagccaccatacccggcctattttattacattttaatttattttattttattatatcatccaccatgtctggcctattttattatattttaagatattttaatatattacgtgtgttgtaattggattatcatcggtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacaga

SEQ ID NO: 17980 - DNA, 2010 bp, Homo sapiens
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagagagccggattccagatcgcgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgtt

SEQ ID NO: 17981 - DNA, 1675 bp, Homo sapiens
gtcgcctctgtgctcgctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactaaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgtt

SEQ ID NO: 17982 - DNA, 2221 bp, Homo sapiens
agcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaagacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcagcctcccaaagtgctgggattacaagcatgagccaccatacccggcctattttattacattttaatttattttattttattatatcatccaccatgtctggcctattttattatattttaagatattttaatatattacgtgtgttgtaattggattatcatcggtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacaga

SEQ ID NO: 17983 - DNA, 1735 bp, Homo sapiens
gtcgcctctgtgctcgctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 17984 - DNA, 2070 bp, Homo sapiens
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagaaagccggattccagatcgcgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 17985 - DNA, 1007 bp, Homo sapiens
ttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 17986 - DNA, 1737 bp, Homo sapiens
gtcgcctctgtgctggctagtcaagtgaaacagtgggagtgaagaagaaacaaagacatctataactggttgtgatcaattagttgtacacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacgtggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 17987 - DNA, 2072 bp, Homo sapiens
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggttcccatcagaaccgcccagaggcggacgctgccttcctggggtgacggagcagcaggaagcgttttcggatcctggaatacgtgggcggcccgtgggaggggctgaggcgcagtttcctactcacccggatcagaatcctccgcggtgctgtttcaagagagccggattccagatcgcgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcgggcaaggccgggcacggtggttcacgcctgcaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccactgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 17988 - DNA, 1005 bp, Homo sapiens
ttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 17989 - DNA, 1005 bp, Homo sapiens; identical to SEQ ID NO: 17988

SEQ ID NO: 17990 - DNA, 1005 bp, Homo sapiens; identical to SEQ ID NO: 17988

SEQ ID NO: 17991 - DNA, 1735 bp, Homo sapiens; identical to SEQ ID NO: 17983

SEQ ID NO: 17992 - DNA, 2223 bp, Homo sapiens
agcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaggacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcaggctcccaaagtgctgggattacaagcatgagccaccatacccggcctattttattacattttaatttattttattttattatatcatccaccatgtctggcctattttattatattttaagatattttaatatattacgtgtgttgtaattggattatcatcagtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacaga

SEQ ID NO: 17993 - DNA, 1001 bp, Homo sapiens
ttcccttttgcacctccgggagctgctgctgagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgttgttggaggctgcaaaatgttagtagatatgaggcgtttgcagctgtaccatattaa

SEQ ID NO: 17994 - DNA, 2070 bp, Homo sapiens; identical to SEQ ID NO: 17984

SEQ ID NO: 17995 - DNA, 2221 bp, Homo sapiens; identical to SEQ ID NO: 17982

SEQ ID NO: 17996 - DNA, 1369 bp, Homo sapiens
cactgcttgagccgctgagagggtggcgacgtcggggccatggggctgggcccggtctttctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatt

SEQ ID NO: 17997 - DNA, 1369 bp, Homo sapiens
cactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatt

SEQ ID NO: 17998 - DNA, 1365 bp, Homo sapiens
cactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactaaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgttgttggaggctgcaaaatgttagtagatatgaggcgtttgcagctgtaccatatt

SEQ ID NO: 17999 - DNA, 1369 bp, Homo sapiens; identical to SEQ ID NO: 17997

SEQ ID NO: 18000 - DNA, 1369 bp, Homo sapiens
cactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacgtggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgcttgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatt

SEQ ID NO: 18001 - DNA, 2446 bp, Homo sapiens
aaatttcgacggggtcttctcacgggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18002 - DNA, 2446 bp, Homo sapiens
aaatttccacggggtcttctcaccgttttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcatctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18003 - DNA, 2346 bp, Homo sapiens
agcggtcgctgagcggggcgcaggtgactaaatttcgacggggtcttctcacgggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18004 - DNA, 2338 bp, Homo sapiens
agcggtcgctgagcggggcgcaggtgactaaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacgggatttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18005 - DNA, 175 bp, Homo sapiens
attcagttggccactgctgagcagctgagaaggtggcgacgtaggggccatggggctgggccgggtcctgctgtttctggccgtcgccttcccttttgcacccccggcagccgccgctgtagagatggggtttcaccgtgttagtcaggatggtctcgatctcctgacctcgtga

SEQ ID NO: 18006 - DNA, 2295 bp, Homo sapiens
agccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18007 - DNA, 2438 bp, Homo sapiens
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacgggatttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18008 - DNA, 2344 bp, Homo sapiens
agcggtcgctgagcggggcgcaggtgactaaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18009 - DNA, 2444 bp, Homo sapiens
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18010 - DNA, 2346 bp, Homo sapiens
agcggtcgctgagcggggcgcaggtgactaaatttccacggggtcttctcaccgttttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcatctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18011 - DNA, 2344 bp, Homo sapiens; identical to SEQ ID NO: 18008

SEQ ID NO: 18012 - DNA, 2346 bp, Homo sapiens; identical to SEQ ID NO: 18003

SEQ ID NO: 18013 - DNA, 2450 bp, Homo sapiens
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18014 - DNA, 2446 bp, Homo sapiens; identical to SEQ ID NO: 18001

SEQ ID NO: 18015 - DNA, 2350 bp, Homo sapiens
agcggtcgctgagcggggcgcaggtgactaaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18016 - DNA, 2166 bp, Homo sapiens
agccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18017 - DNA, 2444 bp, Homo sapiens
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggcttgcattccctccaggagattagggtctgtgagatgcatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 18018 - DNA, 1485 bp, Homo sapiens
gaattttgtgagcgaccgcgctgggccgtttctctttcttttccggaccctgcagtggcgcctaaagtctgcgaggaggaagtcgcctctgtgctcgtgagtccagggatctaagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaagg

SEQ ID NO: 18019 - DNA, 175 bp, Homo sapiens; identical to SEQ ID NO: 18005

SEQ ID NO: 18020 - DNA, 175 bp, Homo sapiens; identical to SEQ ID NO: 18005

SEQ ID NO: 18021 - DNA, 1483 bp, Homo sapiens
gaattttgtgagcgcccgcgctgggccgtttctctttcttttccggaccctgcagtggcgcctaaagtctgcgaggaggaagtcgcctctgtgctcgtgagtccagggatctaagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggcttgcattccctccaggagattagggtctgtgagatgcatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaagg

SEQ ID NO: 18022 - DNA, 1485 bp, Homo sapiens
gaattttgtgagcgaccgcgctgggccgtttctctttcttttccggaccctgcagtggcgcctaaagtctgcgaggaggaagtcgcctctgtgcttgtgagtccagggatctaagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcatctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaagg

SEQ ID NO: 18023 - DNA, 175 bp, Homo sapiens; identical to SEQ ID NO: 18005

SEQ ID NO: 18024 - DNA, 175 bp, Homo sapiens; identical to SEQ ID NO: 18005

SEQ ID NO: 18025 - DNA, 1485 bp, Homo sapiens; identical to SEQ ID NO: 18018

SEQ ID NO: 18026 - DNA, 175 bp, Homo sapiens; identical to SEQ ID NO: 18005

SEQ ID NO: 18027 - DNA, 175 bp, Homo sapiens; identical to SEQ ID NO: 18005

SEQ ID NO: 18028 - DNA, 1483 bp, Homo sapiens
gaattttgtgagcgcccgcgctgggccgtttctctttcttttccggaccctgcagtggcgcctaaagtctgcgaggaggaagtcgcctctgtgctcgtgagtccagggatctaagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaagg

SEQ ID NO: 18029 - DNA, 3044 bp, Homo sapiens
aagtttggtagagtgtgttgtggggacagcagtatggtgtgagggaaggagagagttcagtctattataatcattagtctattgacttgtggtaattgagctataggagataaattcctacttactctacacatttaatggactcttcctcccaccccatcttccctgtccctttctttttccacagcagctctgcaacgggccaatagcttccagtctccaaccccaagcaaataccagaactggaggagagaattctggtggagtttgacgccagtgaacaaaagaactatgtcacctcctaaggacccttctccttctcttcctcttccttcatcgtcttcccattcatcttccccaccatcttcttcttcaaccagtgtttctgggaatgctccagatggttcctccccgcctcagatgacagcttctgagcccctctcgcaagtctcgagaggtcatccaagtcctcccaccccaaactttcggaggcgagccgtagcccaaggagcacccagggaaattcccctgtatctgcctcatcacccaaagccagagtgggcagagtactgcctggtgagccctggtgaagatggcctctcagaccctgcagagatgacttctgatgagtgccagccagcagaggcccctcttggggacatcggaagcaaccacagagacccacaccccatctgggggaaggacaggagctggacagggcaagagctatctcccttggctggagaagaccgggaaaaagggagtactggagccaggaaggaagaagagggagggccagtgctggtaaaggagaagttgggcctgaagaagttagtcctcactcaggagcagaagaccatgttgttggattggaatgactccatccctgagagtgtgcacctcaaagctggggagcgaatttcccagaaaagtgctgagaatggtagaggaggccgtgtgctaaaaccagtccgccccctgctgctccctagggcagcaggagagcccctgccaacccagagaggggcccaggagaagatggggacccctgcggaacaagctcaaggggagcgaaacgtgcctccacccaagtccccactgcggctcatagccaatgccatccgaaggtctctagagcccctcctttccaactctgaaggcgggaagaaggcctgggccaagcaagaatccaaaactttgcccgcacaggcctgcactcgctcattcagccttcggaaaaccaattccaataaagacggggaccagcattcccctgggagaaaccagtcctcagcctttagccctcctgaccctgccctccgcacccacagtttgcccaatcggccatccaaggtctttcctgcacttaggtccccaccctgcagcaagattgaagatgtccccacactcctcgagaaagtgagtttgcaagagaacttcccagatgcttctaagcctccaaagaaaagaatctcacttttttcctccctcagactcaaagacaaatcttttgagagtttcctccaagaatccagacaaagaaaggacatcagggacctctttggcagccccaagaggaaggtgctgcctgaagatagtgcgcaggccctggagaagctgctgcagcctttcaaaagcacctccctgcgccaggcagctcctcctcctcctcctcctcctcctcctcctcctcctcctcctacagcgggaggtgcagactccaagaactttcccctcagagcacaggtaacagaggcttcctcttctgcctcttcaacctcctcctcctctgcagatgaagaatttgatccccagctttccttgcagttaaaggagaagaagacacttagaagaagaaagaagctagaaaaagcaatgaagcagttggttaagcaagaagaattgaaaagactctataaggctcaggccatccagaggcagctggaggaggtggaggagcggcagagggcttctgagatccagggtgtgaggctggagaaggcgttgcgaggagaagcagattcaggcacacaggatgaagcacagcttttgcaggaatggtttaagctggttctggagaagaataaattaatgcgatatgagtcggagctcctaatcatggcccaggaactggaattagaagatcatcaaagcagactggagcagaaactgagagagaaaatgctcaaggaggagagccagaaagatgagaaggatctaaacgaagagcaagaagtattcaccgagctgatgcaagtgattgagcaaagggacaaactcgtcgattccttagaggaacaacgcatcagagaaaaagccgaggaccagcactttgaaagcttcgtattctccagaggctgtcagctgagcaggacttgaggaggcccgtagtccctctccctggctgcacgttgggaccggatcaggccaagtgcaccacacaccctcatgggtctttctgcaggatttatcatccctggaacttgttataccttactgcattttttaaaattaaaattctcttgcacgcatggcagcttcccaaggttcttccagagattcaaatgaagaaaacccaaagactctttggcaattggcagtcaacttcagccaggctctcagactggaggtgttgttggcagatgaccagcattgttttccctagaaagtgacacaaagacttgactttcctgctacttttatcattttccttcccaattcattgagttacatactttaagatttttgagaagctgccttttcattaatatatccatatttgccttttttgtatggatgaccagtttccaaatgtcagaaagaagcagccgcagtttaaagattaggttaatatttaaattgtgtttccagagaaagaggagaaaccttgagattactgattacataaagcaaataactcatatagcaggtgttaattcaatccagggtgaatttaatttaccaggtgcatttataagccttaatataatatacataagcaatgagagcttaatagaacatttgagccttaattttattttaag

SEQ ID NO: 18030 - DNA, 343 bp, Homo sapiens
gtctgactatggtggcagcgagggctcccacacagaaccctgtgaagagaaaccctggcggccaggatccccgcatctaccgcacacgtccctaggggaggccctgagcagggcagtctctccacagtgccctgaggagcccagagctgtgcacgctctgcaacgggccaatagcttccagtctccaaccccaagcaaataccagaactggaggagagaattctggtggagtttgacgccagtgaacaaaagaactatgtcacctcctaaggacccttctccttctcttcctcttccttcatcgtcttcccattcatcttccccaccatcttcttcttcaacc

SEQ ID NO: 18031 - DNA, 2845 bp, Homo sapiens
tctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggcctccctcagtgaaaaaaataccactgcagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccgaaaatttgcctggcaagtcttccttataagacacatcatggtaagttttgtagtcctgtaagattctgcaacacagtcaagaattatacaatcctactagcaatatataaggacccaaaatgtcttctgctaagctcagaggctggggctaaagcatgaggactatgccagctatagaacttggactcataattcgctatccaatttttcatgcagttgtctagtcgggaagtaaggttggaaactaagtctcatttactgattcgtttatgggtagtaccgggatgaacccaccaccacaaagcaaattagacaacttaatgtgaaatcataccattggttgacgtttccttgagttgctacttcgttcatcttcacaacttaacaagtgcacggtcgaattattgtgcaagtggcttttggatatcctgattggggcctaagaagggcattcagacttgaattttaataggcagacagaaagtttgcctaatagttaatacgaaagagtgaaagaaacacaatattcagacaacccacattcttatcctggctctagcagtaaccacgtagccttggataagccattttccttcattaggtcctggtttaatttcctcatctttaaaatgagaaggttaaatttatcttagtactgctgggcgcagtggctcatgcctgtaatctgagcactttgggaagctgaggcgggtggatcacttgaggtcagaaatttgagacgagcctggccaacatggtgaaaccccatctctactaaaaatacaaaaattagctgggcgtggtggcacgtgcctgtaatcccagctactcgggaggctgaggcaggagaatcaattgaacctgggaggcagaggttgcagtgagccgagatggcgccattgcactccagcctgggtgacaaaagcaaaagtccatcttaagaaatatatatatatattatatatattcttagttctaagatttcctttaattctatgattctctggatttaaatgcattattcatatttcttgaagcttagatacagtctaattcatagcaaccatatctgctttatcctaggtgagggtagcagtccacaatggaatagaagaaaatcccattataacaaatgacaaattatatatcatgaatccttctgtctgactaactcaataactttctataaaagccaatggaattcaaataggagctaggagacaacaagttatatatgacagtggaggttgtattccttttatattgctgagaaaactagttaaatgatcagattcttgctgttaagaaacaatttcgtttaatgggatctgtacaactgattttaaaaaaatgctacaaaaagccccaaagcatataatctctactccttacagtctctagaattaaatgtactcatttagacaacatattaaatgcatattttagccactttagagaaacctcataggcacagagtttccaagattaattttaagaatatcttcacgaacttgaccctcctactccacattgcaacatttccatcagacagcatttcaattccagtattatgtatattgcaaattaaacattttaaaatatttttttccaatttatttctcaaaataaaatgtc

SEQ ID NO: 18032 - DNA, 1195 bp, Homo sapiens
attgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccga

SEQ ID NO: 18033 - DNA, 2308 bp, Homo sapiens
atttggaatgagggtgtgagcaactgcaaattcccatctcccttctcattccagcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccgaaaatttgcctggcaagtcttccttataagacacatcatggtaagttttgtagtcctgtaagattctgcaacacagtcaagaattatacaatcctactagcaatatataaggacccaaaatgtcttctgctaagctcagaggctggggctaaagcatgaggactatgccagctatagaacttggactcataattcgctatccaatttttcatgcagttgtctagtcgggaagtaaggttggaaactaagtctcatttactgattcgtttatgggtagtaccgggatgaacccaccaccacaaagcaaattagacaacttaatgtgaaatcataccattggttgacgtttccttgagttgctacttcgttcatcttcacaacttaacaagtgcacggtcgaattattgtgcaagtggcttttggatatcctgattggggcctaagaagggcattcagacttgaattttaataggcagacagaaagtttgcctaatagttaatacgaaagagtgaaagaaacacaatattcagacaacccacattcttatcctggctctagcagtaaccacgtagccttggataagccattttccttcattaggtcctggtttaatttcctcatctttaaaatgagaaggttaaatttatcttagtactgctgggcgcagtggctcatgcctgtaatctgagcactttgggaagctgaggcgggtggatcacttgaggtcagaaatttgagacgagcctggccaacatggtgaaaccccatctctactaaaaatacaaaaattagctgggcgtggtggcacgtgcctgtaatcccagctactcgggaggctgaggcaggagaatcaattgaacctgggaggcagaggttgcagtgagccgagatggcgccattgcactccagcctgggtgacaaaagcaaaagtccatcttaagaaatatatatatatattatatatattcttagttctaagatttcctttaattctatgattctctggatttaaatgcattattcatatttcttgaagcttagatacagtctaattcatagcaaccatatctgctttatcctaggtgagggtagcagtccac

SEQ ID NO: 18034 - DNA, 492 bp, Homo sapiens
atgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtga

SEQ ID NO: 18035 - DNA, 582 bp, Homo sapiens
atttgattacctgaaaccctaaagagacagagggaatgtgtgtatgtctgtgtgtgtgtgaaagggctggagggggcaatggggaatgtcactgaacttagtcttgagcagacctcccaaataaccgtggaattctgatgaaggagacgccaagatgagcagatgatatgaaaaagtcacgcatatgagaaaggaagattccacatcaggggtgaaagaggccaaagggtagggccaagtacggaccatgtagaatgtaaaatttcctctgacttggtagcagagaataataaaagcaagaataatgatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggcctccctcagtgaaaaaaataccactgcagagtgctgggatgagaaatttacctgc

SEQ ID NO: 18036 - DNA, 2155 bp, Homo sapiens
gcagaaaccgactcgacttcctagctgtgggcgcccaaacgtcgtccaccatcccacaatcctctcgtcacgtatttccggtttatctagctcagccgtaagtagtttctctatcagtcgcgcagctgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtgagatttcaatggaaaaagtgaaggtaaagcgttatgtgtccggaaaaaggccagactatgcccctatggagtcctcagatgaggaggatgaagaatttcagttcattaagaaagccaaagaacaagaagcagagcctgaggaacaggaggaggattcatccagtgacccccggctacggcgtttacagaaccgtattagtgaagatgtggaagagagattggctcgacatcgaaaaatagtggaacctgaagtggtaggagagagtgactcagaagtagaaggagatgcttggcgcatggaacgagaagacagcagtgaagaagaggaggaggaaattgatgatgaggaaatagagcggcggcgtggcatgatgcgtcagcgagcacaggagagaaaaaatgaagagatggaagtcatggaagtggaagatgagggtcgttctggagaggagtcagaatcagagtctgagtatgaagagtacacagacagtgaagatgagatggagcctcgccttaagccagtcttcattcgaaagaaggaccgagtgacagttcaagaacgtgaagccgaagcattgaaacagaaggagctggagcaggaagcaaaacgcatggctgaggaaaggcgcaagtacacactcaagattgtcgaagaggaaaccaaaaaagagctggaagagaacaagcgatccctggctgcattggatgcactcaatactgatgatgaaaatgatgaggaggaatatgaggcatggaaagttcgagagctaaaaagaatcaagagggacagagaagatcgagaagcgcttgagaaggagaaagcagaaattgaacgcatgcgaaacctgactgaggaagagaggagagctgaacttcgggcaaacggcaaagtcattaccaacaaagctgttaagggcaaatacaagttcttacagaagtattatcaccggggtgccttcttcatggatgaggatgaagaagtatacaagagagatttcagcgctcctaccctggaggatcatttcaataaaaccattcttcctaaagtcatgcaggtcaagaactttggacgctcaggtcgcaccaaatacactcaccttgtggatcaagataccacctcctttgactcagcttggggccaagagagtgcccagaacacaaagttcttcaaacaaaaggcagctggggtacgagatgtatttgagcggccatctgccaagaagcggaaaactacctagggtccaactgcttattcttccaactgtggaacacaaggggagtctcagcatctggtccttgatttggttttttcattgtttccttggcccctgtatccagatattggacttactgctatacttgtgatactgggtagcccagactttgaaggtgctttgtgaggtttggactcatgctgagaaacccacaggaaagcactgtccaggtaggattagaggcttcccacttaaaactatttctgagaaatcttaggttttatcactgctatggtttcccatatttacttgggactgttctgactttctttttccagcccttagcttgggttagaaaagtggacatgtaagtgaacaatgcattacttctaccttaggtttaggagtaatatacccggaaatctaagctcatggaaacatgttttccatttttgcttggagtccgtttttctagttgtacatactttttgatccatatatgtgtgcatgtcaagaaataaaagaatcacacaacaaggagatttttagcatgatactggaaataaaatgtccaagctgacaagtattaattgcctattaaagtaaaagataacaattgtcaggca

SEQ ID NO: 18037 - DNA, 970 bp, Homo sapiens
gccatgagagctgcctacctcttcctgctattcctgcctggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacaatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaa

SEQ ID NO: 18038 - DNA, 1260 bp, Homo sapiens
gaggaagctttgcacagacgtgaggacggccccgggcgcctctaccccggggacacccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacaatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaa

SEQ ID NO: 18039 - DNA, 1094 bp, Homo sapiens
gccccgtcgggggcccggagggggactcggagcgggccaaggggcggctccggcgggcggactcggagcgggcggcggagtgacccggacagctgtcctctctgacaccaccccggcctgcctctttgttgccatgagagctgcctacctcttcctgctattcctgcctggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacaatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagttttt

SEQ ID NO: 18040 - DNA, 2891 bp, Homo sapiens
ggagctagacggcggtcgggtaggtgacggcttggttggggtcgctgcgaggggactactaggagcgccgaggcgtgagtcgtagcctgtggcttggggtcgggagtgcaggaggcgaaaatgtttgccattcttttgaaagtctggcctgggtgtgggagttcggtcatcgaacacttactgagagccagatacctgccaggcactgccctgggctccagggacacatcagtcaacgaacggaagggccctgctctcaagcagtgcgaaaagcagattataaacaagtcaacaaacgggattatctaaggtggtagttctctactcacatcttttaatcttgaagactagaaaatataactggatctaccacttgtttggaaaatttctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgatgtcatcatagccaaagagggaactagcgtttcaattgagtgtcttctcacagccagtcactatgaagatgtccattggcacaattcaaaaggacagcaactggatggcagaagcagaggtggaaagtggttggtttctgataacttcctaaacatcaccaatgtagcttttgatgaccgtgggctctatacctgtttcgtcacctctccaattcgtgcctcctactctgtcaccctacgtgttatcttcacctcgggagacatgagtgtctattacatgattgtttgcctgattgcctttacaatcacactcatcttgaatgtcacacggctgtgcatgatgagcagccatcttcgcaagactgagaaggctatcaatgagttctttagaactgaaggggctgagaaacttcagaaggcctttgagattgcaaaacgtatccccatcattacctcagccaaaactctggagctcgccaaagtcacacaatttaagaccatggagtttgctcgttatattgaagaactggcaagaagtgtccctcttccacctcttattctaaactgtcgagcctttgttgaggagatgtttgaggctgtgcgagtggacgaccctgatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttggatctgatacttatcttgggacttcagtttttccgtcaataagatgagggattaggtgagatctgaagttgtttctagctctatagcttcttaacccatcacctttaaattaccagaatcttcactcatctctaagtaaacctttcccgggacttttactcgcttcttttggaaaggattaagctgagatctaaatttccacaccaatgtcataatgcacagaggtttttgaaaaacatctgagtgtttttcagatgttttgccatgtggagcatataatgatatgtgcaagattgaatcttttcaatgtagcacatgtctgtagggttatacagatgtcagagagctaactgctctgtaaactactttccatgagtaaattggtccttggtgggggtgtatcatatttttaacttactgagatatcattttagttcattgaggttggcagggattgcctaactgatcttccaaagtgagcagtttatttctaaggtataacgtctttgatgcttttagaataagaacagtgtcaaatcatctgtcttctggaaaatcatggattttcatatttctgttaacagaatttctcaggctttccctttttaaaagtattggactctacaaataggttctatatttgggatctcatcctaggagaaaacccaaaactggattcctcttaagacctctgtcaaccctcctgccctttgtggtcttaggtatggtgctataggttgcatgcgtctttatcttgtttgtttggttaatattttgttgttgaggtttttatttttgtttacttcagatacataattctgagctatggctgcttttgtagcctttccaagaagcactaacctgaaataagattagataattgtgagggtgtgttactatattaaaatacacacacaactgatctagacatcaagaggaagaaaaatgatggatgatgccacctgcttcaactgtatataataaacacttatgatgaca

SEQ ID NO: 18041 - DNA, 5049 bp, Homo sapiens
aaacttccgagttaagccgccgctgaggccggaaggagctagacggcggtcgggttctctactcacatcttttaatcttgaagactagaaaatataactggatctaccacttgtttggaaaatttctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgatgtcatcatagccaaagagggaactagcgtttcaattgagtgtcttctcacagccagtcactatgaagatgtccattggcacaattcaaaaggacagcaactggatggcagaagcagaggtggaaagtggttggtttctgataacttcctaaacatcaccaatgtagcttttgatgaccgtgggctctatacctgtttcgtcacctctccaattcgtgcctcctactctgtcaccctacgtgttatcttcacctcgggagacatgagtgtctattacatgattgtttgcctgattgcctttacaatcacactcatcttgaatgtcacacggctgtgcatgatgagcagccatcttcgcaagactgagaaggctatcaatgagttctttagaactgaaggggctgagaaacttcagaaggcctttgagattgcaaaacgtatccccatcattacctcagccaaaactctggagctcgccaaagtcacacaatttaagaccatggagtttgctcgttatattgaagaactggcaagaagtgtccctcttccacctcttattctaaactgtcgagcctttgttgaggagatgtttgaggctgtgcgagtggacgaccctgatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttggatctgatacttatcttgggacttcagtttttccgtcaataagatgagggattaggtgagatctgaagttgtttctagctctatagcttcttaacccatcacctttaaattaccagaatcttcactcatctctaagtaaacctttcccgggacttttactcgcttcttttggaaaggattaagctgagatctaaatttccacaccaatgtcataatgcacagaggtttttgaaaaacatctgagtgtttttcagatgttttgccatgtggagcatataatgatatgtgcaagattgaatcttttcaatgtagcacatgtctgtagggttatacagatgtcagagagctaactgctctgtaaactactttccatgagtaaattggtccttggtgggggtgtatcatatttttaacttactgagatatcattttagttcattgaggttggcagggattgcctaactgatcttccaaagtgagcagtttatttctaaggtataacgtctttgatgcttttagaataagaacagtgtcaaatcatctgtcttctggaaaatcatggattttcatatttctgttaacagaatttctcaggctttccctttttaaaagtattggactctacaaataggttctatatttgggatctcatcctaggagaaaacccaaaactggattcctcttaagacctctgtcaaccctcctgccctttgtggtcttaggtatggtgctataggttgcatgcgtctttatcttgtttgtttggttaatattttgttgttgaggtttttatttttgtttacttcagatacataattctgagctatggctgcttttgtagcctttccaagaagcactaacctgaaataagattagataattgtgagggtgtgttactatattaaaatacacacacaactgatctagacatcaagaggaagaaaaatgatggatgatgccacctgcttcaactgtatataataaacacttatgatgacatttcttgcctggctgagatctgatataatggaattgtaaatactcttcagaacaatttcttcagctacaggaagcgtggtgccatataattttaagaacttggcagtggagctccatttggggcttcacgtttcttcatatgacttctgattattgaagcattacttcagctagaggctcctgagggaaatgttcagaggaggttttatcaggattttaatttaaggtttcaaacaggggaagacaggaaattcaaagcgtgacgggataaaactcatgcctccctttgtccaggcttatcagaagtaatacatctgctctgaatagcatgaatgaatcaatgtgcagttttatcagatggcatcatggataaagatgataatgctgccttttctgtctctcaggctgtttccatggaaacctctagagccaaataaaagctaaccaatcatttagccaaagcttgccttggctcatagactggtatttctttaaggaaaattgtttttatatatttgactataagagcaaaggctcttgaacatatcctagattatggaacactttttcccttcccttttctctggaaaaattaaattttttttctgtccactgagactggagtgcagtggcaagatcatagctcactgcagcctccaactcctggggtcaagcgatcgtcctgcttcagcctcccaagcagctaggactacaggtgtgcaccacctttcctggctaatttttttttattttttgtagagatgggggtctcactttgttgcccaggctgaccttgtacttgtggcttcaaatgatcctcctgccttacctcccaaagtgttgagattacaggcatgagccactgtgcctggccaaaaaacattttaaatcccttgtctgggggtcagtcctctaaacatccctcagatttcagatagtactttcaaccctgtcctaacatagcaggtttgcagtaatcttttagaatatagcttgtcaaattagagaatggttttaccccacatgttctcataggagacattattatttagaaccctaaggtagacatgtttaaaatcaaagtcctaagaaacagaactttggaaaaatggaggaaatgtttttaaagtctgtaagtttgcacgatactgtatagtaactaaatgcatgctactccgttgtatcctagttattttagaaacagaggtggcctaatttggtggccaaagtaactggtttactttgagtgtaccagcttatggtgccattgatgaggaattaaagtaggtcaaaatttaattggagttggtattacttcgtaaagctagttttcaagaggaagaaaaccacacttactaatgttttctgtatctaatcaaatactcttcatatataattaagcctcatgttatcttttttttaaatcaaccttttgaacttcaactacagtctaaaagtcttgatggtaactatagtgtaattatctttttgtctcactggattttatagttagtggaaaatgcctttacaaaatgtatttaaaatagctgtcatctcatttgtaaattttgtcgtgtattgtgatatagtgaaccttattgtccttatgaaatggtagctttgtgaaatacattcaccaaaaatcaaaatttgaacatctttatgattccttaccagctgaagccagatagacaggtattaattgagctgatgccccacttgagtttatagactgtttgataactgcctgtcctccaaattgtgtatgtatatgttacgatggtttaattcttgagtcagggccagcacgcatttatattttctaccaattaccttgatagaaatatcttagaaattgctgacctggaacggttgtgagaagactcctggcttctttcttgcctcacttaacaaatattttaaggtcaaagcaatatctgtgcacggctttccttttgctcctccagacaagtgaggctgttggtatagtcctcttcaccctctgcatgtagcttcaccctagatcagacttttgtctcttgggtcccagatggcacaggagcactgcatgcttgttttctagagcccagccagtcatgggtgctagcctagtctccacacaccagcaagtagaacccaagtgtattgtataaatatttcctgagtaccagtaagagaatgcattcttttctcatctaggccaggaatgttgaaaatgctcagccttacatagaaactcctagattttcactaacgcatttcacaaaagtaaataagtatttcatataattcagaggatgtttaaattgtcagcattttaataaatacttgcattataattttgtctcttttttaaagaaagtcatacttgaatataatttattaaacgttcaatggagtatatagtctatttgaaatttt

SEQ ID NO: 18042 - DNA, 1186 bp, Homo sapiens
aaacttccgagttaagccgccgctgaggccggaaggagctagacggcggtcgggtggaaagtggttggtttctgataacttcctaaacatcaccaatgtagcttttgatgaccgtgggctctatacctgtttcgtcacctctccaattcgtgcctcctactctgtcaccctacgtgttatcttcacctcgggagacatgagtgtctattacatgattgtttgcctgattgcctttacaatcacactcatcttgaatgtcacacggctgtgcatgatgagcagccatcttcgcaagactgagaaggctatcaatgagttctttagaactgaaggggctgagaaacttcagaaggcctttgagattgcaaaacgtatccccatcattacctcagccaaaactctggagctcgccaaagtcacacaatttaagaccatggagtttgctcgttatattgaagaactggcaagaagtgtccctcttccacctcttattctaaactgtcgagcctttgttgaggagatgtttgaggctgtgcgagtggacgaccctgatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttggatctgatacttatcttg

SEQ ID NO: 18043 - DNA, 520 bp, Homo sapiens
agacggcggtcgggtaggtgacggcttggttggggtcgctgcgaggggactactaggagcgccgaggcgtgagtcgtagcctgtggcttggggtcgggagtgcaggaggcgaaaatgtttgccattcttttgaaagtctggcctgggtgtgggagttcggtcatcgaacacttactgagagccagatacctgccaggcactgccctgggctccagggacacatcagtcaacgaacggaagggccctgctctcaagcagtgcgaaaagcagattataaacaagtcaacaaacgggattatctaaggttctctactcacatcttttaatcttgaagactagaaaatataactggatctaccacttgtttggaaaatttctctaccaagcaataaattacccgctgtgcttttgttgtagtgtagaagtttttgagttctccaaatctaaacaagattttgtcccattttcccatgaagctacattgttgcttattcactttagtggcaagtattattgtgcc

SEQ ID NO: 18044 - DNA, 567 bp, Homo sapiens
gagctagacggcggtcgggtaggtgacggcttggttggggtcgctgcgaggggactactaggagcgccgaggcgttctctactcacatcttttaatcttgaagactagaaaatataactggatctaccacttgtttggaaaatttctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgatgtcatcatagccaaagagggaactagcgtttcaattgagtgtcttctcacagccagtcactatgaagatgtccattggcacaattcaaaaggacagcaactggatggcagaagcagaggtggaaagtggttggtttctgataacttcctaa

SEQ ID NO: 18045 - DNA, 643 bp, Homo sapiens
ctactgccccggaagtgctccttcagcgcagaggcgtgccggtgtgtccgagaaaacttccgagttaagccgccgctgaggccggaaggagctagacggcggtcgggttctctactcacatcttttaatcttgaagactagaaaatataactggatctaccacttgtttggaaaatttctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgatgtcatcatagccaaagagggaactagcgtttcaattgagtgtcttctcacagccagtcactatgaagatgtccattggcacaattcaaaaggacagcaactggatggcagaagcagaggtggaaagtggttggtttctgataacttcctaaacatcaccaatgtagcttttgatgaccgtgggctctatacctg

SEQ ID NO: 18046 - DNA, 1873 bp, Homo sapiens
cggctggcgggggcccagcgcataactctgggcggttgcagtctggggccgcagacacccagccactctgagcagaactgacagcatgaaggcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaacctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaagga

SEQ ID NO: 18047 - DNA, 1903 bp, Homo sapiens
gacagcatgaaggtacggggcccagggtcgggggactcatagcatgggggaactgagcccactccagaggcccctggccacagagggcactatgaaggcacaaggagttctcttgaaactcgcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaacctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaagga

SEQ ID NO: 18048 - DNA, 901 bp, Homo sapiens
tcgtgacaaagcaaattgtctggtatcatgaatttggaacaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatg

SEQ ID NO: 18049 - DNA, 909 bp, Homo sapiens
gaattcaagtcctaaagcctacagttttgaatactactgaaatgacaagttattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatg

SEQ ID NO: 18050 - DNA, 979 bp, Homo sapiens
ggcagatggaagacttgggggggtctctgccagctggaagtgcttggctccacttagcagctaaacttagcttttcaatcgatcgcttttgaaagggaattgtatttctgtccccgtgcggattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatg

SEQ ID NO: 18051 - DNA, 914 bp, Homo sapiens
cctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaa

SEQ ID NO: 18052 - DNA, 298 bp, Homo sapiens
tcgtgacaaagcaaattgtctggtatcatgaatttggaacaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaa

SEQ ID NO: 18053 - DNA, 202 bp, Homo sapiens
gtacctgtgaaggggaagatgttaccctggagagatggttcattgactcatcagattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaag

SEQ ID NO: 18054 - DNA, 365 bp, Homo sapiens
ggggtctctgccagctggaagtgcttggctccacttagcagctaaacttagcttttcaatcgatcgcttttgaaagggaattgtatttctgtccccgtgcggattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttg

SEQ ID NO: 18055 - DNA, 1331 bp, Homo sapiens
tcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagaatcaaacaaaccctgagcatttatcttgcctcttctatataaagtttaactcggcataaccaattgctgatgaagaagaaatgtttccttgtagaagcaaaccagtgaataattgaagaaaaaatttatcttttcaacatctaatgagttaatggattcaagcaaagattatccacggctgttaacaacacaaaaagacaatcggaaattagctattactgcgggaagtacccaataccatctatgaaactgtgtggacaaaaacactgacaaaaatctccacgaatctctaattttgaatacaaatttaaagaaaatgcaaaggattaaaatagaccatgatgaagtcagaaaaattcagacagagaaaaatgctccaggaccagaaacccatttcttccgcaaaagcttccaggtagagattgactgaccgagagaacagagacatagagagaacctagagattaaaagaaacttgagcgatttgtcagcattcagttgcaacgtatggatgtgatttgaattctaatttaaaaaccaaagtagaaagtggtaaacaattggggaaatgtgaacaatgatagaatatttaatattaatgaaatatgttaaatattttcagatatgataatggcattgagtatgtaaaaaagagcctgtttttaaagaaatacctctgaaatacagatgatataatatcatctgtatattagatgatattatatatatcagtatcatcagaataaagtaaggttagcatgaattgttaattgttgacactgtgcaataggtacgtggataattactatactgttctcattccttttatttatgtttgaaatgttctaaaattaaaagttaaagcatagagtgtaaagttgagcaaattcctccaagacctaaatatagcttatcaaaacttacattaattagatgctgactgttgagctaatacttttttttaatgatgtgtgcttcagtttattgcacttttcaaatactccagttttttgtgtgcgtgtgttttttaaattttattattattaaagttttagggtacatgtgcacaa

SEQ ID NO: 18056 - DNA, 801 bp, Homo sapiens
gctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacaacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatacttgcagaagctgttcccaccatgaaggtaatatggtatcatttgttaaataaaaataaagtctttattctgtttttcttgaaa

SEQ ID NO: 18057 - DNA, 1780 bp, Homo sapiens
aaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacaacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatacttgcagaagctgttcccaccatgaagttattggtttcttgaactctttggggcacaatttcaagaggaagaagtaaaaaaaggataccatttcaaggaattgcccagggacaagtgcgaagagaatattctttctcttggctgaggaaggttctcttgtgatcctgggaaatgctagaccgtgagcatcttgatggaggatgtgaactgccacttcctcacaggcagcaggcaggtgctgaataagtgcttgctgaatgaatgaatgaatcacgccaaggggcatgttacctgttccgccaaaatctgctgctgctgctgctgctgctgctgcctttgctcccgcaggaactgttgcttctgctgctctatcaactgggcccgctgatcaatgagcatctgcttcatgatggctgcttggggctggctgcccaggaagccggggcctgcgggactggctcctgagaccatgccacctgagcctgggggcacggaggactgcatggggcctgtggttcggggaagtccaactggatgctgctcctgggaagacaagagagagggagatgcagggattccccatagagactcactgctgtttgaagggaagcccctggaaaaagggaacggggcagaagtcccagcttatggactggagggtttttgagtggcacgcattgcatttccataaacgtagcttcaaacccgaccttacctgagtagaatgagagaggccacaagggacagtaagagagcatggctctgggaagtccaaggccaagtccagtctgtttcggatgggactgactattgcatatagactggattttcaactaacatcctgtgttcctccaaggaaagggaataagccctcaggctgagctcacctaaagtctggaacacgagacacatcctgacctcacctgttaatccttatttcttactgtctacttggccaaaatggacgtcttctttgcaagtaggagggacatttgcagaaaactgcaggaatttgttaatcaacagatctgatatttgatggaattctaacgagttgcaacatttgagagcttagatatatgtcagaaagaaaaatcctcctggccagagttgttgatggtgagaactgggaatgttttacaccgatcaaagctatgtaatctcctaatatttttaaaaatagaattgagtcggccgggcgcggtgtctcacgcctgtaatcccagtactttgggaggcccagtactttgggtggatcacgaggtcagttcgagaccagcttggccaagatggtgaaaccctgtctctact

SEQ ID NO: 18058 - DNA, 634 bp, Homo sapiens
ggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacatttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatacttgcagaagctgttcccaccatgaaggtaatatggtatcatttgttaaataaaa

SEQ ID NO: 18059 - DNA, 706 bp, Homo sapiens
attccccgaagttgtggcttctgctgatactttccttgagagtcacgagtttacaagctacataatagcgtcgggggcaaggacaggagatgccctggaggggaaggcgcttccggctctgcagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 18060 - DNA, 717 bp, Homo sapiens
gcagttttgttctgctccagctgttcgaaggtgatccagggacagatcttccatcctcctaacatatagttagcttccactctccaaatattccaccagcaacattgatgaatattgaagactatggactgtgagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 18061 - DNA, 680 bp, Homo sapiens
cccacaccgcgctgcgcagttttgttctgctccagctgttcgaaggtgatccagggacaggagatgccctggaggggaaggcgcttccggctctgcagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 18062 - DNA, 613 bp, Homo sapiens
atgccctggaggggaaggcgcttccggctctgcagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacct

SEQ ID NO: 18063 - DNA, 1015 bp, Homo sapiens
atgcccgtgcttcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtttttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 18064 - DNA, 678 bp, Homo sapiens
cccacaccgcgctgcgcagttttgttctgctccagctgttcgaaggtgatccaggtgagagatgccctggaggggaaggcgcttccggctctgcagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 18065 - DNA, 1098 bp, Homo sapiens
atgccaaggctcacctttgctccgaaggggtggcctcaccccccgacctcactccactggtggcttttccaggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccac

SEQ ID NO: 18066 - DNA, 3384 bp, Homo sapiens
cccaagactgtccccgctggaggcggtagagggatccagaagtaatgagatgctaatgagtcgcgaataaagcccgggcggcgccccgcgcccctcgcggaagcccacactccgcgcgactccaggcgcacgccccgggccgccccgcatcccagcatccccgcccgatctcggcgtttccgcccccgcccccgcccccgccctcccacccgctcagacctggttgccagcccaacaggaagcggcccctcccggcttcggagccgccgccactcatctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctacgagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccac

SEQ ID NO: 18067 - DNA, 3645 bp, Homo sapiens
cccaagactgtccccgctggaggcggtagagggatccagaagtaatgagatgctaatgagtcgcgaataaagcccgggcggcgccccgcgcccctcgcggaagcccacactccgcgcgactccaggcgcacgccccgggccgccccgcatcccagcatccccgcccgatctcggcgtttccgcccccgcccccgcccccgccctcccacccgctcagacctggttgccagcccaacaggaagcggcccctcccggcttcggagccgccgccactcatctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctacgagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaa

SEQ ID NO: 18068 - DNA, 3678 bp, Homo sapiens
tttagctacaagtacttcagatccagctcagcacctgcagctgacacaggagcctggtccgccaccacccactcaccacgtgccccagccaacgccacttggccaggagcagagctgacctgtaaacacgtttgactgcttgattgggctcttcttataagccagctctgactggattttgaacgcttgaaatcaggctctccacaccattgacttgcagatgcttctgtgagagctgtgatggctaactgatgtttataatgccctccatccaggtagcaagatgtgtgtatgtcttgtctaagccactcatctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctacgagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccac

SEQ ID NO: 18069 - DNA, 1902 bp, Homo sapiens
ccaaaatatgtactacccagcgaggcccaggtggtccctgcaaagcagctgcagcctcaggacaggagcagcgtgccggagcactcattgttggctggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctacgagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccac

SEQ ID NO: 18070 - DNA, 887 bp, Homo sapiens
gccggtaagtcgtccagcggagccggctgcgagccccgcggccgggtggggtgaggtggggtgcgcttccggggaaacgcagctgcggtcgctcgggaaccacgcctggcagccactcatctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaacttt

SEQ ID NO: 18071 - DNA, 3906 bp, Homo sapiens
ctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaa

SEQ ID NO: 18072 - DNA, 3477 bp, Homo sapiens
aagagaagactttaaccactgtgatgcctgagaatccagtgagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaacc

SEQ ID NO: 18073 - DNA, 2931 bp, Homo sapiens
atgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaaaagaagtcaccttcagggttccattttcatcccagccatttgagaacagtgcatcctcaggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctga

SEQ ID NO: 18074 - DNA, 573 bp, Homo sapiens
ggtagatggtgtgcttccagctgataccaggagcagaagttttgagaagagactgtttgtcatgtggatagtggaaagccctgctctctggtaacgaatgaagaaaggctttaaagctgggtgtctacggagaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactcctt

SEQ ID NO: 18075 - DNA, 566 bp, Homo sapiens
agatggtgtgcttccagctgataccaggagcagaagttttgagaagagactgtttgtcatgtggatagtggaaagccctgctctctggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatc

SEQ ID NO: 18076 - DNA, 546 bp, Homo sapiens
aatgaaggtccggccctccccagtgtaggaggcaggtaaatgatcacactgtgacaaatgctcaaacggggatgtgcttgcaaaggctagagacagcacgggaggaaggagcagtccattctgctgagagtgtagctcagttccaagaacacttattgatgcttacaccgggccaagccctgtgatgggccctgggttccagaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagg

SEQ ID NO: 18077 - DNA, 473 bp, Homo sapiens
gaacaaactttctttgcaggattgggtcaaccatggggtctgatttggagatgcttcccttctctgtcagctgctcatgtctcaaatgaagagccttttgtgatgaccatgtatggaatagtgtctgaagtaccactgcactgtacctgtctttgcgtctaaacatcactaccatcatcacgggacaaaccgcccatctcagtggtgtctggcagtgagctgaacatggcaacccgtgtgtgtctcatcccagaaagagaagactttaaccactgtgatgcctgagaatccaagacagagtctcactgcgttgcccaggctggtcttgaactcttggactcaagcaatcctcccaccttggcctcccaaagagcaggaattacaggtgtgacgtttctccagatacttcatgctgttcacctgtgtcctcgccgcaccactgccgcacacgactcctgaaccatgggggaaaa

SEQ ID NO: 18078 - DNA, 589 bp, Homo sapiens
accaagactaatgaaggtccggccctccccagtgtaggaggcaggtaaatgatcacactgtgacaaatgctcaaacggggatgtgcttgcaaaggctagagacagcacgggaggaaggagcagtccattctgctgagagtgtgagtaccgagaaagcatggcactgggcttgaaggatgaggagttcgccagacacagaggatgaggagagcagcacgtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggct

SEQ ID NO: 18079 - DNA, 516 bp, Homo sapiens
aatgatgctgattctctcctctgcacagcctcacaatcacctgaatatccccttcaagtgcatcctgccctgggtttcctgtgtgcacattgagtttccttctctagttgaagagagagtttgcagaggctggcaaacctggagctggactgaatggcctggacaggtggagcaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaag

SEQ ID NO: 18080 - DNA, 593 bp, Homo sapiens
ataggggaagagattacctgcaatgccacatcgacaggccaaaaggcacaattctgtatctgttataaatatttatgtttagtattgaacactaaatagtgtggttaatatttgaatgtcttaaagaaattgcatttttacttctcagcacccatcccccaccctaacctcatcgtccaaagctgacctctgcctccccctactttcacaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgc

SEQ ID NO: 18081 - DNA, 3585 bp, Homo sapiens
atgcactgaggtaccaagactaatgaaggtccggccctccccagtgtaggaggcaggtaaatgatcacactgtgacaaatgctcaaacggggatgtgcttgcaaaggctagagacagcacgggaggaaggagcagtccattctgctgagagtgtgagtaccgagaaagcatggcactgggcttgaaggatgaggagttcgccagacacagaggatgaggagagcagcacgaacatggcaacccgtgtgtgtctcatcccagaaagagaagactttaaccactgtgatgcctgagaatccagtgagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacacttttt

SEQ ID NO: 18082 - DNA, 1822 bp, Homo sapiens
aggtccggccctccccagtgtaggaggcaggtaaatgatcacactgtgacaaatgctcaaacggggatgtgcttgcaaaggctagagacagcacgggaggaaggagcagtccattctgctgagagtgtgagtaccgagaaagcatggcactgggcttgaaggatgaggagttcgccagacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtg

SEQ ID NO: 18083 - DNA, 3284 bp, Homo sapiens
cagcgcgcgctcctgcagccccggcggagtcccggcggggagcgcccgcgtaggcaggcacccggggcagccctccgtcctcgccgcgcggcctgagaacccctgggccctgggcgagggggctgggctgtgcagcccccgaggctaactgggcgggatcgcagctgcaggggttgtgcgagcagccacggcggcacctgtgccctgcgggcacccaccctgcccctgccgaggcaggcgcccaccgccggcggtgatgcggctgtgaagccctagtcgattaacgtgacagtgtcaggtggacccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactaacaccaagtgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagctgacacaagagcgtggggccagccagccgtcctgctgcctgcctgggcaggttcgccctgcccccaccccccggtggaaacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcaggtcagcacgcagggctgcagggcgcccacccgccacacggccctaa

SEQ ID NO: 18084 - DNA, 2963 bp, Homo sapiens
tgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactaacaccaagtgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcaggtcagcacgcagggctgcagggcgcccacccgccacacggccctaagagcctcctcacctctgtgtgtctcggtttcttctcagtgaagggaggcctcctgtctttcctgctgcccgcagtccattctccccagtcccttttaggtt

SEQ ID NO: 18085 - DNA, 3366 bp, Homo sapiens
cagcgcgcgctcctgcagccccggcggagtcccggcggggagcgcccgcgtaggcaggcacccggggcagccctccgtcctcgccgcgcggcctgagaacccctgggccctgggcgagggggctgggctgtgcagcccccgaggctaactgggcgggatcgcagctgcaggggttgtgcgagcagccacggcggcacctgtgccctgcgggcacccaccctgcccctgccgaggcaggcgcccaccgccggcggtgatgcggctgtgaagccctagtcgattaacgtgacagtgtcaggtggacccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactaacaccaagtgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcagagactgggtctccccatggttgcccaggatggtctcaaactcctgggctcaaatgatccacccacctcagcctcccacagtgctgggatcacagatgtgagctactgggcccagctgagcataagagtcttttctgtgtcacctttgtgttccctacagtgtctagcaagtgcgttgtgaggggaagataattgaataaattttatccaggt

SEQ ID NO: 18086 - DNA, 4922 bp, Homo sapiens
cttccctgccctcccctgcccgctgcggcggctgcagcctccgccccgcgcgcttgctccccgcgccgccgccgccgccgcctccgccgctgctgccgcacctgccaccatgtcgccgccgccgggtcatgtctgactctctctggaccgcgctttctaatttctcgatgccctccttccccggcggcagtatgttccgccgcaccaagagctgccgcaccagtaatcggaaaagcctcatcctgaccagcacttcacccacgctaccgagaccccactccccgctgccaggtcacctaggcagcagtcccctggacagcccccgaaacttctcccccaacacccccgcccacttctcgtttgcctcctcccgaagggcggacggacgccggtggtctctggcctcgctcccttcatctggctatggcaccaacacgcccagttccaccgtctcgtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggccactgcgcagatggaggagaagctgcgcgactttacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagatgtggtgcatctggaggaacaggacagtggtggttccaacacccctgagcaagacgatctctctgagggccgcagcagcaaggccaagaaaccgccgggggagaatgacttcgataccatcaagctcataagcaacggtgcctacggcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggcggcgactgtgccaccctgctgaagaatattggagcgctgcccgtagagatggcccgcatgtactttgctgagacggtgctagccctggagtatttgcacaactatggcatcgtgcaccgcgacctcaagcctgacaacctccttatcacctccatgggtcacatcaagctcacagatttcggcctctccaagatggggctcatgagcctcaccaccaacttatatgaaggccacatcgagaaggacgcccgagagttcctggacaaacaggtgtgtgggaccccagagtacatcgcgcccgaggtcatcctgcgtcaaggctacggcaagccagtggactggtgggctatggggatcatcctctacgagttcctggtgggctgtgtgcccttcttcggagacacaccagaggagctatttggacaggtcatcagtgatgacatcctgtggcccgagggggatgaggccctacctacggaggcccaactcctcatatccagcctcctgcagaccaaccctctggtcaggcttggggcaggcggcgcttttgaggtgaagcagcacagtttctttcgagacctggactggacagggctgctgaggcagaaggccgagttcatcccccacctagagtcggaagatgacactagctactttgacacccgctcagacaggtatcaccacgtgaactcctatgacgaggatgacacgacggaggaggagcccgtggaaatccgccagttctcttcctgctctccgcgcttcagcaaggtgtatagcagcatggagcagctgtcgcagcacgagcccaagaccccagtagcagctgcagggagcagcaagcgggagccgagcaccaagggccccgaggagaaggtggccggcaagcgggaggggctgggcggcctgaccctgcgtgagaagacctggagagggggctctccggagatcaagcgattctccgcgtccgaggccagtttcctggagggagaggccagtccccctttgggcgcccgccgccgtttctcggcgctgctggagcccagccgcttcagcgccccccaagaggacgaggatgaggcccggctgcgcaggcctccccggcccagctccgaccccgcgggatccctggatgcacgggcccccaaagaggagactcaaggggaaggcacctccagcgccggggactccgaggccactgaccgtccacgcccaggtgacctctgcccaccctcgaaggatggggatgcatcaggcccaagggctaccaatgacttggttctgcgccgggcgcggcaccagcagatgtcaggggatgtggcagtagagaagaggccttctcgaactgggggcaaagtcatcaaatcagcctcagccactgccttatctgtcatgattcctgcagtggacccacatggaagttcaccccttgctagtcccatgtctccacgatctctgtcctccaacccatcctcacgggactcctcacccagccgggactactcaccagctgtcagtgggctccgctcccccatcaccatccagcgctcgggcaagaagtatggcttcacactgcgtgccatccgtgtctacatgggtgacacggatgtctatagtgtccaccacattgtctggcatgtggaggaaggaggcccagcccaggaggcaggactctgtgctggggacctcatcacccacgtgaatggggagcctgtgcatggcatggtgcatcctgaggtcgtggagctgatccttaagagtggcaacaaggtagcagtgaccacaacgcccttcgaaaatacctctatccgcattggtcccgcaaggcgcagcagctacaaggctaaaatggctcggaggaacaagcgaccctccgccaaggagggccaggagagcaagaagcgcagctccctcttccggaagatcacgaagcagtcgaacctgctgcatactagccgctcgctgtcgtcgctgaaccgctcgctgtcatccagcgatagtctcccgggctcgcctacgcacgggctgccggcgcgctcgcccacgcacagctaccgctccacgcctgactccgcctacctaggcgcctcatcccagagcagctccccagcctcgagcacgcccaactcgcctgcgtcgtcggcgtcgcaccacattcggcccagcacgctgcacggactgtcgccaaagctccatcgccagtaccgctctgcgcgatgcaagtcggccggcaacatccctctatcgccgctggcacacacgccgtcccccacgcaggcgtcaccgccgccactgccgggccacacggtgggcagctcgcacactactcagagcttcccggccaaactgcactcatcgcctcccgtcgtgcgcccgcgccccaagagtgccgagccccctcgctcgccgctcctcaagcgcgtgcagtcggccgagaagctgggagcctctttgagtgcggacaagaagggcgcgctgcgcaaacacagcctcgaggtgggccacccggatttccgcaaggacttccatggcgagctggcgctgcatagccttgccgagtccgacggtgagacgcccccagtcgagggccttggcgcgccccggcaggtcgccgtccgccgcctgggccgacaggagtcacctttgagcctgggcgcggacccgttgctgcccgagggtgcctccaggccaccagtgtcgagcaaggagaaggaatccccggggggcgccgaggcgtgcaccccaccccgcgcgacgacccccggtggccggaccctggagcgggacgtcggctgcacgcggcatcagagcgtgcagacggaggatggcactggcgggatggccagggctgtggccaaggcggcgctgagcccggtgcaggaacacgagacaggccggcgcagcagctctggcgaggcgggcacacccctggtacccattgtcgtagagcctgcgcggcccggggctaaggctgtggtgcctcagcctctgggcgcggactccaaggggttgcaggaacccgcacccctggcgccttccgtgcccgaggccccccggggccgggagcgctgggtgttggaggtggtggaggagcgcaccacgctgagcggtcctcgctccaagcccgcctccccaaagctctccccggagccccagacaccctccctagccccagcgaagtgcagtgcacccagcagtgcagtgaccccagtcccacccgcatccctcttgggctcaggcaccaagcctcaagtggggctgacctcccggtgccctgctgaagctgtgcccccagcaggcctgaccaaaaaaggagtgtccagtcccgcacccccgggaccatagccaagggggtcatcggccccgcgctgtacagcctccgtatacatatgtacacatataaataaagtgcgtccgtgctgcgtg

SEQ ID NO: 18087 - DNA, 2225 bp, Homo sapiens
cgcacctgccaccatgtcgccgccgccgggtcatgtctgactctctctggaccgcgctttctaatttctcgatgccctccttccccggcggcagtatgttccgccgcaccaagagctgccgcaccagtaatcggaaaagcctcatcctgaccagcacttcacccacgctaccgagaccccactccccgctgccaggtcacctaggcagcagtcccctggacagcccccgaaacttctcccccaacacccccgcccacttctcgtttgcctcctcccgaagggcggacggacgccggtggtctctggcctcgctcccttcatctggctatggcaccaacacgcccagttccaccgtctcgtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggccactgcgcagatggaggagaagctgcgcgactttacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagatgtggtgcatctggaggaacaggacagtggtggttccaacacccctgagcaagacgatctctctgagggccgcagcagcaaggccaagaaaccgccgggggagaatgacttcgataccatcaagctcataagcaacggtgcctacggcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggcggcgactgtgccaccctgctgaagaatattggagcgctgcccgtagagatggcccgcatgtactttgctgagacggtgctagccctggagtatttgcacaactatggcatcgtgcaccgcgacctcaagcctgacaacctccttatcacctccatgggtcacatcaagctcacagatttcggcctctccaagatggggctcatgagcctcaccaccaacttatatgaaggccacatcgagaaggacgcccgagagttcctggacaaacaggtgtgtgggaccccagagtacatcgcgcccgaggtcatcctgcgtcaaggctacggcaagccagtggactggtgggctatggggatcatcctctacgagttcctggtgggctgtgtgcccttcttcggagacacaccagaggagctatttggacaggtcatcagtgatgacatcctgtggcccgagggggatgaggccctacctacggaggcccaactcctcatatccagcctcctgcagaccaaccctctggtcaggcttggggcaggcggcgcttttgaggtgaagcagcacagtttctttcgagacctggactggacagggctgctgaggcagaaggccgagttcatcccccacctagagtcggaagatgacactagctactttgacacccgctcagacaggtatcaccacgtgaactcctatgacgaggatgacacgacggaggaggagcccgtggaaatccgccagttctcttcctgctctccgcgcttcagcaaggtgtacagcctccgtatacatatgtacacatataaataaagtgcgtccgtgctg

SEQ ID NO: 18088 - DNA, 5738 bp, Homo sapiens
taggcaggcggctgagccggcggcgggtggcctgcccaacgtgtgctgggtgggagaaggcgaggcgtcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagataatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaattggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcatcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtagagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccatc

SEQ ID NO: 18089 - DNA, 2757 bp, Homo sapiens
attcatttgggatctggaacttgtcactgtcccactgctgcctcgtgggctcttaggtcttttgtggggggatgggaggggtgttctgaagatcatgtttttgaagaaaagtactttaatttttgccaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagataatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaattggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 18090 - DNA, 5110 bp, Homo sapiens
taggcaggcggctgagccggcggcgggtggcctgcccaacgtgtgctgggtgggagaaggcgaggcgtcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaattggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcatcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccatatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtagagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatag

SEQ ID NO: 18091 - DNA, 3052 bp, Homo sapiens
taggcaggcggctgagccggcggcgggtggcctgcccaacgtgtgctgggtgggagaaggcgaggcgtcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagataatttggagaaacttttacaagatgagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaattggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcatccctcctgaaggttgctggaaggcccagcactttctcccagcacttcgggactcacccccaccagcagttgctctcctcccagctccacctctgggaagctgagcatgtggtcctggaaatcccttattga

SEQ ID NO: 18092 - DNA, 2107 bp, Homo sapiens
aatgatctagctcctgaagaaagaggctttcgttactgtccaagaagtgaagaccagtgagtctagcgataaagaaacaaaagagcccctgacagtatcgaaagaatctgacatttgctttgtctgtacaaaggatgaaaggaattttgccgacttagtcaaaacaataactggttttatatcattttgagtctaaaatacaggcatcagaatcgtatgtttttctttgtatttctgaagaattgtcatctttttaaaaacgtatgtggagtggttttgtttctggaaaggaaaacgtgacatggattttataagcttagtagctgtaggtggagactcttgttttgtttgctaaacctttttaataagcagcaaagtcaggatatcaaagattggaatttttcccccggaaccttttgttcttttcttagtacttcaaataatttcaaccaaaggggtatgcatggaaaatgaaaacaaatatgaagtctttccgctatttggcagtgcttcagatgagatgtatctatacttctgtgaagaaagacgtgattctgatatgaggcagtgattgtatacttacgctggacagagggataactggtttagtggaacagtgggttagtggtgtgctgaaaggattgtttgcctctttatccagcagtaagtaggcactagtagttgactgtctggggagtggcttttttttgtctgatatctattatggatgattccagtattctgagaaggagagggttacagaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactggcccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccatctttatgtcttttgcttgcttgttttccttcggtcaacccacatgtaactaggtcctgtgttgctgctgggaatatagtggtgaataaaacagtttccacc

SEQ ID NO: 18093 - DNA, 5893 bp, Homo sapiens
atggacgagtcgagcctcctgcggcgccgcgggctccagaaggagctgagcctgccacgccgaggacgtggctgccgcagcgggaaccgcaagagcttggtggtaggaacgccctccccgaccctctcccggcccctgtcgccattgtcggtcccaacggcaggcagcagccccttggatagtcctcggaatttctcggctgcctctgccctaaatttcccctttgcccggagggcagacggcagaagatggtccctcgcgtctctcccatcttccggctatggaaccaacacacccagctccaccctctcgtcaagctcatcctcccgggaacgtctccaccagcttcccttccagccgacgccggacgagctgcacttcctgtccaagcacttccgcagctcagagaatgtgcttgatgaggaaggcggccggtcaccccgcctccgaccccgctctcgcagtctcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagctgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccggccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagatgatggcagcggcggccccctcatgagccccctttccccgcgctctctgtcctcgaacccgtcgtcccgtgactcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcggggctggatggggcaagaatgggggacaagggtggctttgtaaatagcagcaaatccctgcaactaatttattactttttttttctttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaaga

SEQ ID NO: 18094 - DNA, 2963 bp, Homo sapiens
gggagtggctgctcgcggaggggcagtgtctgcggggccgctgtatgctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcagaccccaaatcagatcaagtcgggaactccataccgaactccgaagagtgtgagaagaggggtggcccccgttgatgatgggcgaattctaggaaccccagactaccttgcacctgagctgttactaggcagggcccatgatatcccttggccagaaggtgaagaaaagttatctgataatgctcaaagtgcagtagaaatacttttaaccattgatgatacaaagagagctggaatgaaagagctaaaacgtcatcctctcttcagtgatgtggactgggaaaatctgcagcatcagactatgcctttcatcccccagccagatgatgaaacagatacctcctattttgaagccaggaatactgctcagcacctgactgtatctggatttagtctgtagcacaaaaattttccttttagtctagccttgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatttatttattttgtttattgcactttatgaaaactgaagcatcaataaaattagaggacactattgagagtgagccactagcttgattttctttctcctctgatttcagttcactgttcagtttagcattaaaataataaaataatcatacagttcc

SEQ ID NO: 18095 - DNA, 3080 bp, Homo sapiens
gggagtggctgctcgcggaggggcagtgtctgcggggccgctgtatgctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcagcagaccccaaatcagatcaagtcgggaactccataccgaactccgaagagtgtgagaagaggggtggcccccgttgatgatgggcgaattctaggaaccccagactaccttgcacctgagctgttactaggcagggcccatggtcctgcggtagactggtgggcacttggagtttgcttgtttgaatttctaacaggaattccccctttcaatgatgaaacaccacaacaagtattccagaatattctgaaaagagatatcccttggccagaaggtgaagaaaagttatctgataatgctcaaagtgcagtagaaatacttttaaccattgatgatacaaagagagctggaatgaaagagctaaaacgtcatcctctcttcagtgatgtggactgggaaaatctgcagcatcagactatgcctttcatcccccagccagatgatgaaacagatacctcctattttgaagccaggaatactgctcagcacctgactgtatctggatttagtctgtagcacaaaaattttccttttagtctagccttgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatttatttattttgtttattgcactttatgaaaactgaagcatcaataaaattagaggacactattgagagtgagccactagcttgattttctttctcctctgatttcagttcactgttcagtttagcattaaaataataaaataatcatacagttcc

SEQ ID NO: 18096 - DNA, 3623 bp, Homo sapiens
ttttcctcacactaaatcgaaaactctccctgttggtcctgatctgtttcagtcaggcaaattacatcctgggaaaacgtcagatgacaggggaggccactcgcttcctgctcatccagtttcgacactttctgtgctttcattagcttccagacctcagccctggccctcgctttactgtacagtcagaactggtttctacgcctcgcgagggtgggaggtcgtgtatgggaggaggaccgcttcccaccagcctcgttgggaagccaggagaaatctcttcaaatcctgcgattcagagtcaagtcccagtcgtcctttttctggtcggcccagaactgtttgtgcctcctccctcatgaggaatgatgtcagtggggccgcggtcgccgcccacgaagagtgtaaggctgcgaagtcggggctttcccgacgccccctccgtccgcgtctgcgtaggggaggtgacgagggcggggcgcggcggcggggtgacgtcacggccgcgcgcggcgtgggcggagcctcactttgaacccagttggcgggagtggctgctcgcggaggggcagtgtctgcggggccgctgtatgctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcagaccccaaatcagatcaagtcgggaactccataccgaactccgaagagtgtgagaagaggggtggcccccgttgatgatgggcgaattctaggaaccccagactaccttgcacctgagctgttactaggcagggcccatggtcctgcggtagactggtgggcacttggagtttgcttgtttgaatttctaacaggaattccccctttcaatgatgaaacaccacaacaagtattccagaatattctgaaaagagatatcccttggccagaaggtgaagaaaagttatctgataatgctcaaagtgcagtagaaatacttttaaccattgatgatacaaagagagctggaatgaaagagctaaaacgtcatcctctcttcagtgatgtggactgggaaaatctgcagcatcagactatgcctttcatcccccagccagatgatgaaacagatacctcctattttgaagccaggaatactgctcagcacctgactgtatctggatttagtctgtagcacaaaaattttccttttagtctagccttgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatttatttattttgtttattgcactttatgaaaactgaagcatcaataaaattagaggacactattgagagtgagccactagcttgattttctttctcctctgatttcagttcactgttcagtttagcattaaaataataaaataatcatacagttcc

SEQ ID NO: 18097 - DNA, 19141 bp, Homo sapiens
ggctctgattcagttttctttttcttctcttttccttttttttttttttttttttttttttttaggaatgcagagcagttgctggggtgattgacctaggcacagtggagatatttcccatcttcaaagccatgcaaaagggcctccttgaccaagacacaggcctagtgcttctggaatctcaggttatcatgtctggcctcattgcccctgagacgggtgaaaacctctctttggaggagggcatagccagaaacctcattaatccccagatgtaccagcagctccgggagctacaggatgccctggccttaataagcaggcttactgagagcagaggccctctttctgtggtggaagcaattgaaaagagaataatcagtgagacagttggactgaaaatcttagaagctcacctggcaactggaggtttcagtctttcccctagtgagaactgtattaacctggaagaggcttttcatcaaggcctcatttctgcatggcttcattcagtattagagtcttatcttagaacatccaagaatttgatagaccctaacacagctgagaaaattggtttgctggatctgatgcagcgatgtattgtccaccaggaatcaggattcaaattactgcctgtcaaacaattggcaggggggatggtgagcttgaaatcaggccggaaggttagcattttccgtgcagttcaggaagggctaatagataggcaggtcactgtccggttgctggaagctcagctttttgctggtggcatagtagatccaagaacaggacacagacttacagtggaagaggctgtaagacataatctgattgaccaagatatggcctgtgctatcctcataaggcagcttcagacaggaggcatcatagacactgtcacggggcaaaggctaacaatagatgaagcagtgagcaatgatctagtagctgctaagatcgcccttgtgattctggagtccctctggtcattcatggggttgctgtggcctgaatctggagagatcctcccaattacagatgccctagaacaaggtattgtgtctactgaactagcacataaaatccttagtaaccgacagcatattaaggctctgtttctaccagcaaccacagagattttgtcctggaagaaagcaatagaaagtggtatcctggatagagatcttgccaataacttaaaatcgatttgtatacctgatgtgatgccccacatgcaactagcagactctgcagaacaaaatattaatcctggagcagcagttctaccgtgcagcaagagccaccctaaggccacagcaagccagagtgagaatctgttgttccagctgatgactcacagctatattaatgtgcaaaatggacagaggctgcttctgttagataaagagctgatggagacactaacatccagagatgagtatcaaacaagtcctccaaaagtggttgaaattgggcatcaaaggcaaaaaactcctgagggattgcaagaatcagctaatgtgaaaatctcaggaactttcagcagtgggtggactgtgaggctgcctgagttccagttttcttctcagaacaaagaatatcccgatcgggaagattgcactacagaaaaaggcaaaaagaccactgtagaaacagaagattcttctgtagagaaccctgaacaggatctgtttgtagaacaaaaagagagaaatccaaacattgatgctttgaaggtaataaataaagtcaaattagaggtacaaaggcagttgataggtacccaaagggaagaccaaacagcagtgtctgtcagagaaaatgccagcaggggacacctcctgaccatacctcctgctgaggcggaaggtgtgccgttggtggttgacaaagatgttttttctgttgaaacaccaaagaaagaacatcaacctctaagaaacacttcctttacatgtcagaatgaacaagcacacactcttgagactgaatatattcatgatgaaactggaggatctcacataaaaccccaaagcaaaaagttacaagttcaggtaaagaaaactctaggtataaagttagaactaaagtctgaaactgatgggaatgttcatcctctggacaaaaaggaaatgttaaagaaaacatttctggctaaggatgaccataaagaaagtcaagaagcacagaacatcgcaggtggtagtatgatgatgtcagaaaagaccgatgaggaagatagtggcagggaaatttttctgtcatgcagtcatccattagaattgcttgaagaagctaccttaaatgtattatctgcacagttactagatggtggtatctttcatgaacaaacaggtcaaaagctcttactaaatgaagcaatatcccgaggcattgtgccaagtcacactgccgtgaagcttatggagaagctgaacatgtttcaggggttctttgactctcagacttgtgagtctttgacaactgaagaagtcattaatgaaggtctgatggatgagaaattattacataatgtcctcatggcagacaaagctataagtggtgtcttagacccccgtacccagacactgtgctctgtaaaggatgcagttacagttggacttcttgacaaggaaacagccaccagaattttagagaggcaggtggtgactggtggaattattgatctgaaacgaggcaaaaaagtttcagtaactttggcctcaactcttggcttggtggacgttgctgaccagccagaacttataaatctggagaaagcttccaaaggtagagatgctgaaaaaacagttagggagagattaattagtttacaaatggaaacaacaggacttatagaccctgatagtaaagcacctttaacagttgtgcagtccattgacagaggtcttttggagagagaggaggccgttcgtttgttgactaagcaagtggtagatggaggtatcattcaccatatatctgggatgagactttctgttgataatgccttcagacatggcttaattggtgaagatttagccgagaaactcaaaagagttgagaacttaaacatccatcagatttttaatcctgaaacgaaggaaaatatttccctccctaaagccataaaattagatcttattacctcagacctgaaaagagaaatccaggaggttcaggcctttactggaaactttgtggatctcatttctggtcagagattgaccttggcagaagctaaaaaagaaggactgttaactaatgaagcagtattgtctccaggaatgatgcatggcattgtagatcccgagaactgcagaattgtcccctactcagaattagtcaagaaatgtaagattgatattgaatctggacagagatatctagaagtaattcccttctcagacattaaagatggggtgagcgacaaagtgcttacattgtctcaagcaattcagcttggaaaagtagactttgcatctacgctgaaggttctagaagcccaggcaaatactggtggaatcatagatactgctactggaaaaagactgacattggcatcagctttggaagagaaactggtggatgaaaacatggtcagaattattgcatctcatcaggtgttaaatggaggaattgttgacatatttagtgatcagagagtgactttagtagaagctattgagaaaagactgatcagccctgaactggcaaatatgatccaaatagatagttcagagttcagcgatcacagggctcagattgaaaagcaagaagggattgaagtgtgtgcattacaaaatgaatttctaggaaaggatatgttaattgcttgtaatcagactgctgaaatgagttgtaataaagtagaagagagtgagagattatttcaagttgaaaatcagtctgcacaagaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaagactaaagtgttaaatcagcacacacagctagaaggccgacttcaagatctgagagcctgggttggcaataaaaatcttattctgaacagcaagggatctaacagtgaaatagatgttgacagcctgaacctctgcctccaacagtatgaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgccgctcaggtggatgccttgcagggccatcttcaacaaatggagcaggaagccctggtgaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaata

SEQ ID NO: 18098 - DNA, 17668 bp, Homo sapiens
atcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacaggtatcacagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagctt

SEQ ID NO: 18099 - DNA, 17538 bp, Homo sapiens
atcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaata

SEQ ID NO: 18100 - DNA, 17948 bp, Homo sapiens
atgggaaattcactgggctgttttaaggagccgaaagagtcaatagctattcctgagaaggctcccatatctcctaagaaaagggttcggttcaaaaggaggtggagagggaagaaaatccctactccagaggcatctcaccaggaagaaacctcagaaggaactggagtcattgaagagactgaaaccctaacgaagttaacagagagtctccaaaaggaagacggagtgggaggggtagagcatacccccccagatattttgctgcctggggactcagcccccaactcacgggtagtcgatcgggggatgatagtacaggtaaaggagagattccaaggggaggtccagaccgcccaccttttgttagagaatgagtcatcagttgctggaggggtctgggattccctggaagaggggatgactgtcattgctcacctgcttgataacccagcagaaaggaactgcgagaagtcagtgagccaactggtggaatttcctaggacagcatcctgcagcagcagggctgtgttgctgcctttgcaaggagagactgcagtggagaaaggaaatattcagcgtgggtttcggagctgtgctttgcctaggacagactaccccactgataaaggaaatcaagaacaattttcagagggctggagtgtggaggaaggaaccaagagtgtttcaggtgcccctcagacagcttcctggattatagaatgttctgtttcttcattactactggaccagcctggaggccaaagacgcacggagccttcccatgtgggtcaagtgcccccccaggattccagactgcctacttctcagagtgatttgtccatcagtggtgtgactgtgagcattttgccctcctcctctggctatggcagtgatgggccacacatacatgggatccagcctaaagatacagaacctgaaaagagctctacttccttctcagaagaggatggcactctttctctggaggcaagccacaccccatcatggggtctggaagagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatgtttcaggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagatttgtttagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagctt

SEQ ID NO: 18101 - DNA, 23440 bp, Homo sapiens
ttttgtctgctcacattcacccctttctccttcagatcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaaggaatgcagagcagttgctggggtgattgacctaggcacagtggagatatttcccatcttcaaagccatgcaaaagggcctccttgaccaagacacaggcctagtgcttctggaatctcaggttatcatgtctggcctcattgcccctgagacgggtgaaaacctctctttggaggagggcatagccagaaacctcattaatccccagatgtaccagcagctccgggagctacaggatgccctggccttaataagcaggcttactgagagcagaggccctctttctgtggtggaagcaattgaaaagagaataatcagtgagacagttggactgaaaatcttagaagctcacctggcaactggaggtttcagtctttcccctagtgagaactgtattaacctggaagaggcttttcatcaaggcctcatttctgcatggcttcattcagtattagagtcttatcttagaacatccaagaatttgatagaccctaacacagctgagaaaattggtttgctggatctgatgcagcgatgtattgtccaccaggaatcaggattcaaattactgcctgtcaaacaattggcaggggggatggtgagcttgaaatcaggccggaaggttagcattttccgtgcagttcaggaagggctaatagataggcaggtcactgtccggttgctggaagctcagctttttgctggtggcatagtagatccaagaacaggacacagacttacagtggaagaggctgtaagacataatctgattgaccaagatatggcctgtgctatcctcataaggcagcttcagacaggaggcatcatagacactgtcacggggcaaaggctaacaatagatgaagcagtgagcaatgatctagtagctgctaagatcgcccttgtgattctggagtccctctggtcattcatggggttgctgtggcctgaatctggagagatcctcccaattacagatgccctagaacaaggtattgtgtctactgaactagcacataaaatccttagtaaccgacagcatattaaggctctgtttctaccagcaaccacagagattttgtcctggaagaaagcaatagaaagtggtatcctggatagagatcttgccaataacttaaaatcgatttgtatacctgatgtgatgccccacatgcaactagcagactctgcagaacaaaatattaatcctggagcagcagttctaccgtgcagcaagagccaccctaaggccacagcaagccagagtgagaatctgttgttccagctgatgactcacagctatattaatgtgcaaaatggacagaggctgcttctgttagataaagagctgatggagacactaacatccagagatgagtatcaaacaagtcctccaaaagtggttgaaattgggcatcaaaggcaaaaaactcctgagggattgcaagaatcagctaatgtgaaaatctcaggaactttcagcagtgggtggactgtgaggctgcctgagttccagttttcttctcagaacaaagaatatcccgatcgggaagattgcactacagaaaaaggcaaaaagaccactgtagaaacagaagattcttctgtagagaaccctgaacaggatctgtttgtagaacaaaaagagagaaatccaaacattgatgctttgaaggtaataaataaagtcaaattagaggtacaaaggcagttgataggtacccaaagggaagaccaaacagcagtgtctgtcagagaaaatgccagcaggggacacctcctgaccatacctcctgctgaggcggaaggtgtgccgttggtggttgacaaagatgttttttctgttgaaacaccaaagaaagaacatcaacctctaagaaacacttcctttacatgtcagaatgaacaagcacacactcttgagactgaatatattcatgatgaaactggaggatctcacataaaaccccaaagcaaaaagttacaagttcaggtaaagaaaactctaggtataaagttagaactaaagtctgaaactgatgggaatgttcatcctctggacaaaaaggaaatgttaaagaaaacatttctggctaaggatgaccataaagaaagtcaagaagcacagaacatcgcaggtggtagtatgatgatgtcagaaaagaccgatgaggaagatagtggcagggaaatttttctgtcatgcagtcatccattagaattgcttgaagaagctaccttaaatgtattatctgcacagttactagatggtggtatctttcatgaacaaacaggtcaaaagctcttactaaatgaagcaatatcccgaggcattgtgccaagtcacactgccgtgaagcttatggagaagctgaacatgtttcaggggttctttgactctcagacttgtgagtctttgacaactgaagaagtcattaatgaaggtctgatggatgagaaattattacataatgtcctcatggcagacaaagctataagtggtgtcttagacccccgtacccagacactgtgctctgtaaaggatgcagttacagttggacttcttgacaaggaaacagccaccagaattttagagaggcaggtggtgactggtggaattattgatctgaaacgaggcaaaaaagtttcagtaactttggcctcaactcttggcttggtggacgttgctgaccagccagaacttataaatctggagaaagcttccaaaggtagagatgctgaaaaaacagttagggagagattaattagtttacaaatggaaacaacaggacttatagaccctgatagtaaagcacctttaacagttgtgcagtccattgacagaggtcttttggagagagaggaggccgttcgtttgttgactaagcaagtggtagatggaggtatcattcaccatatatctgggatgagactttctgttgataatgccttcagacatggcttaattggtgaagatttagccgagaaactcaaaagagttgagaacttaaacatccatcagatttttaatcctgaaacgaaggaaaatatttccctccctaaagccataaaattagatcttattacctcagacctgaaaagagaaatccaggaggttcaggcctttactggaaactttgtggatctcatttctggtcagagattgaccttggcagaagctaaaaaagaaggactgttaactaatgaagcagtattgtctccaggaatgatgcatggcattgtagatcccgagaactgcagaattgtcccctactcagaattagtcaagaaatgtaagattgatattgaatctggacagagatatctagaagtaattcccttctcagacattaaagatggggtgagcgacaaagtgcttacattgtctcaagcaattcagcttggaaaagtagactttgcatctacgctgaaggttctagaagcccaggcaaatactggtggaatcatagatactgctactggaaaaagactgacattggcatcagctttggaagagaaactggtggatgaaaacatggtcagaattattgcatctcatcaggtgttaaatggaggaattgttgacatatttagtgatcagagagtgactttagtagaagctattgagaaaagactgatcagccctgaactggcaaatatgatccaaatagatagttcagagttcagcgatcacagggctcagattgaaaagcaagaagggattgaagtgtgtgcattacaaaatgaatttctaggaaaggatatgttaattgcttgtaatcagactgctgaaatgagttgtaataaagtagaagagagtgagagattatttcaagttgaaaatcagtctgcacaagaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaagactaaagtgttaaatcagcacacacagctagaaggccgacttcaagatctgagagcctgggttggcaataaaaatcttattctgaacagcaagggatctaacagtgaaatagatgttgacagcctgaacctctgcctccaacagtatgaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgccgctcaggtggatgccttgcagggccatcttcaacaaatggagcaggaagccctggtgaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagta

SEQ ID NO: 18102 - DNA, 4393 bp, Homo sapiens
atcacttctccctgggctcccaggccctcctgcagcagcccctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggtggaggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataag

SEQ ID NO: 18103 - DNA, 1565 bp, Homo sapiens
cttcttccctttcccctcccccgctggccagttgtttcctgggctttgtctgagatacactgtacagttttagtcccagtctactagcgcctgctgaaaaacagtcagaagtgagatggaggagaagctgccaggaagtttctgacaacactaagctccggcctctgcctctgctgatagtacaggacaacagtaacctcaggagaaaggcatccagaggcctgcgctgagcttgtggctaactcaagggaggagaaaggacgggcctggaaatgcccctcttagattcatcttatttaccaccaaccatctttattttgactcacgttcttggagttgctggtgttctatactggaagaggcatgccagaggtagagcagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccggtaagaacagtggaatttctgtgctcctgcagggctttttctcatctcttgtttgtaattagttataatactgtttccatctcctcaatcaaaaatcaaagctttgattcatttgttcatttgaaaaagaaacatttatttaactacttttctaggaactgggtacaagtagcagtgaagaaaacagcgaaagttcttgctctcatggaacttatctttcagtagggagaataggtaataaatgtatgccatcaagcagtggtaaatgcaatggcaggattagaaagtggcagaggtttgtggtactttggacagggtggtcagagatggcctttttggtgagcgtgttaaagcagagccatgagggagtgagtcatccaggcttctggggtcagagtgttccagtcggaagaaatacaaatgcaaagggcctggagtgagggcttgcttagagtggtttagggacagcaggtggctgaagtgaggtgaggacgataggaattctgaatgacaaaaataaaaattgttgagttcttagtggtcataaacatgccccaattttcagttctaaccgacgatatttttcccatgacattcaacaaacctaaactgtatgtttaagtttagcattagggagcactgggcccctggtgtatacttaaaaatggaatttgtactcttctaaacctcctgc

SEQ ID NO: 18104 - DNA, 17278 bp, Homo sapiens
atcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacaggtatcacagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagctt

SEQ ID NO: 18105 - DNA, 2294 bp, Homo sapiens
aggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagt

SEQ ID NO: 18106 - DNA, 17724 bp, Homo sapiens
gatgaagaaactgagtctcagagaggtgaagtgacttgcccaagatcacagcaattatcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagctt

SEQ ID NO: 18107 - DNA, 10258 bp, Homo sapiens
tgcagactcttccctgaagctgccggctgaggccggagctgccgcctccatgagaggcttcctcctacaccccagggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggagggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgcagatagtgta

SEQ ID NO: 18108 - DNA, 10553 bp, Homo sapiens
gctgccggactaacactccgcgggtgtttccatggagaccgaggccgagcctgcgcggcctcacggcgttgccatggagacaactccggggctggggctccgaagtcccggcgcaccgctggctcagaaccccgcggagctgctgtgcgaggccggagccgcggtggcggctgcacgctgggacctgcagaagcactctttgctaattgtgatcggcgatatcggtacagagagtcagctgagggccgtgcgggcccaccttgaacaagggattctctcctggaacattgacctgtcatcctttgacttgaaccaacagttgagactcttcattacccggcacctagctcacttctcctcagaggtcaaaggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggagggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgcagatagtgta

SEQ ID NO: 18109 - DNA, 10281 bp, Homo sapiens
actcccaccctaagtgctgcagactcttccctgaagctgccggctgaggccggagctgccgcctccatgagaggcttcctcctacaccccagggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgagtgtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggagggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgcagatagtgta

SEQ ID NO: 18110 - DNA, 1881 bp, Homo sapiens
atggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaaaaaaaaaaaaaaaaaaaaaaaaaaaag

SEQ ID NO: 18111 - DNA, 2241 bp, Homo sapiens
ggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccagattttattgatctaatccaaagtatcttataacttctggctggaattaagattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctaattctaccttgtcaaagattcctgctttacagggtagcacaaagtccccaagatacagctcagcctgccctagcacgactaaaagggctacattttctgacagtttattaatacagcccacctcagcaggctccacagaccgtttgccatactcaaaatcagggaacaaggacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaa

SEQ ID NO: 18112 - DNA, 9711 bp, Homo sapiens
atggcaaaccgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagtgccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaagagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacctaactgcta

SEQ ID NO: 18113 - DNA, 2038 bp, Homo sapiens
gctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgta

SEQ ID NO: 18114 - DNA, 614 bp, Homo sapiens
ggagaccagatgatgacattcataggctgatagactcgactcctggggacacacttggatggaggcaattaaaatgcctgtcaggcatttggtaccagaagcccctatggcaaaccgctaaatcattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctga

SEQ ID NO: 18115 - DNA, 5303 bp, Homo sapiens
tcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacctaactgcta

SEQ ID NO: 18116 - DNA, 5472 bp, Homo sapiens
atggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagtgccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaagagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtga

SEQ ID NO: 18117 - DNA, 5004 bp, Homo sapiens
atggaaaccacaggggaccagggaattgaaggaatggcctatatggacgaaaatagaaatattacatttacctgtcccagaacaccatcagagctgataaataaatcatctcctctagaggttctggaatcagcagcctgtgaaaaactgcccactcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaacaccagaaatccagtcagatttcttacatagcaaagtcgaagctcctccttcagaggtggcggatacgttagtaataatgactgcttccaagggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcacgc

SEQ ID NO: 18118 - DNA, 1564 bp, Homo sapiens
atctgtgaggaaccagtggccaagaagagagaagaattggctcacttcagcaacagcagcagcaactctgggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggaatagccaggccagaagaaggaaggcctgtggtgagtgggacaggaaatgacatcaccaccccaccgaacaaggagctcccaccaagcccagagaagaaaacaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggagga

SEQ ID NO: 18119 - DNA, 5142 bp, Homo sapiens
acccgctggtggcccggtccgcgtgtgcgccgactctcgcactctcctcgctccgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattc

SEQ ID NO: 18120 - DNA, 2282 bp, Homo sapiens
aagacagatgcagccaatagatacactgcagtggctgacaaaccaagtaaaaggagtaatgatggaaaaagtaaaaaggttaaaaatagttctcctgagaagcacattctggagaataagatagatgcaacaaaaatacatgttcccatggaaaccacaggggaccagggaattgaaggaatggcctatatggacgaaaatagaaatattacatttacctgtcccagaacaccatcagagctgataaataaatcatctcctctagaggttctggaatcagcagcctgtgaaaaactgcccactcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaacaccagaaatccagtcagatttcttacatagcaaagtcgaagctcctccttcagaggtggcggatacgttagtaataatgactgcttccaagggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggccaaagtagagaaaaaaacagaggcagctgctacaacccgaaagcctgaatctaatgcagtcactaaaacagccggcccaattgcaagtgcacagaaacaacctgcggggaaagt

SEQ ID NO: 18121 - DNA, 5302 bp, Homo sapiens
aggccccacccgctggtggcccggtccgcgtgtgcgccgactctcgcactctcctcgctccgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcacgc

SEQ ID NO: 18122 - DNA, 5590 bp, Homo sapiens
ctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatc

SEQ ID NO: 18123 - DNA, 3478 bp, Homo sapiens
cttagtgcttggattggcaccatactgtgttttaaattgcagatctaaacagagtgctagttcacgggaaattacattctcagattaaagtagcattttgttgtgcagaaagcagcaggttccttcctttctttcgctttcattcattcttcctttctttctttctttcacatttgtaagtgcatttaatactcaactgcttgaggagagaggggcattgagggagagatgaattttgtcatgaatactggggaattggtgtgatgtcactgcaagctctgtgtgatcgtaggtggtattagagctccaggagcgaaagcagggagagcagtggaggagagacgatgtcgctctcagacaagcagacagcctctctcactgccgcgtacggtcagctcagtaagggcaagcctgcagagtgccgaatggactccccaaaagaaatcagtcaagccggattcgaatggcagaggacagagggcaaactgaatgaaattgggctgaatgtcagcatggacgggcaaccaaaagatgggcttgtgaagaatgccagcttcctggagcagaacaagctctgcttttttgaggggaagctagacaaagagctgagcattgaaatgcaggacaaggactgtcaagaagcctcaggtcaccttgagagcaggtatgtgatttcagagacctgccatcccttggaggggaactcggtacaccagaagacctccgagttccatctgggactcatagaggggccagacaaaaacaaaaccattccagttcaggggaaggtggcagggaagaatggactagagaccaagagccagtcagatctggatttccctggggctgctgacatccctaccagatatgttaaggagcaggaaaccagtgtttggaaccccagctttcatccagtggctcaaggctctctgggctcaagggaagcaactccgggagagatggagaatagcatcacccctggctgcccagtgattggggtggtaaatgataactctgagcagctgaagtgtgagtccccactcctggtgtctctagcccacccagcccccattattgagcattcacccaccaccattccgccaatcactatggtgttcacccaggaacatttgaatgcaagctgtcacatcagagaccatgataaggagttggagaaattgagttctaccgaggaggctgtgctcaaccaagccccccagcagaaaaaggcagtgcgcagggccctgtctgaatgttctcacctctcagttcccccagctgtcaaccttgcagataagtaccctgaactccctgcccgagaagagccttcttctggcctgctgcctccccctagtagcccaatgcctagtcctacacctgggaaactgggagctcctgctatgaagcgctccatgactgtgggtgaggaacagacagctagctacaaattgagccctgggaaactgcccatcttgtctactaaagagatacctcctttcatctgtgaggaaccagtggccaagaagagagaagaattggctcacttcagcaacagcagcagcaactctgggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggaatagccaggccagaagaaggaaggcctgtggtgagtgggacaggaaatgacatcaccaccccaccgaacaaggagctcccaccaagcccagagaagaaaacaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatg

SEQ ID NO: 18124 - DNA, 8920 bp, Homo sapiens
acctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagacctcccactacccccacaccctgccagcctttcttttcatcttcctcttgatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcagccaacttcatgtattgcggtacccctcccacacaagccaaacaagtttgcagacccagtgaccgcaggtcaacccggcccaagcctgccagggtccctcctgagctgctgggaggctctcctccatggaagactcttgatcacaggctgggccactgctctttgtctgagtcaggttgggtctctggttcatcctcctgtggtgggcctgggaaccaaagaaaaagtattcatgttgactcacttgaaccccagagggatcttggcagggaggcctgggatatagaaagcacaccaataatgatgaagaaaaagaagaagaaaccaaagcaaaagagatattctcaaccacgggctggaggaccttcggatgatgacaatgcagataagcctaaaggtcatccatttgcagctgacacacaaaaatcaggtgttctccccagccagcctaccactatgggtacagaatatggacttgtatctggagaaaacttgaaaagggaatgtttagttaactccagtgcagccagactggtagctgagaactttgtctcagagagtctcagaattcctttatatccttctgaagaagcccccaaaactgcaataagttctcagtctaagctgagagtagaggaagagagcaaaagtaacaagtcagtactacaaaaccaagacaagaaattgctgaagcaacatgaatacaaaccacagcctgcaccccacctgaagactcctgtagataaaagccagtcagtaggccctctcaatctgaaaggacccctagcagaagtttctgcatacaatgtagaaacccctttggatatcagacttaaagagggttgctctcctttcttggaccaagaggttatgggtgtagtttcaaaacccacagcagcaaaagaaataccaaatttggtacccactttgatagcaagtaatccattagaatgtaatctaaaagaagggaataatgaaagtaaaatgactaaactgcagaatgtcaaactgaaggagtttcctgaaggagctgaagaggataaagaactaaaaaaggaagcttttcccaacgaaagacaagagatcagcatctttacttctgagcagctgcagggccaagtgttggtacaggtccctggggtagagaatgaaccatttaagagaatggcaggtgatggcaaaagcaggaagggaaggggaagttctgggaaaatgagaacagattctgggaaggtaaaagcaaaatctgagctgccatttcttctggacagccagaaggacggaagggctgttctcataccgagtgagccagtctctaaaactgaaggaatgactactcaggataagagtgaggagctggggctgaattcttcaaagcaaccaggcactaaggctgatctcacggaggcagtggtgatgggggagcctaaagagatgactcagcctaaggtggcaggcaccatgcaggcattgattcctttggaaagtggatcaggcatgactcagacttctggtgttagcacagaaacaggagatgtagtcaaagatatgggtgtcaataaccagagcaaggaaggaaggtgtccatggaaggatcatgaggcagctccctggatttctgaaaagcctaaaaagagaggcaatgaaggcaaaagcaaaaagtttaaaaataattattccacacagcctgctagaatggagaggaaggaagaaatccttaacccaccttttgaagggaaggatggagatactggtagtattccccataaaagcaaggaaataggatttactttccccaaaatgcatgattcttcgttctcacatacaccagatacacccacagtggaagcagttgacaggaagggtggaaattttcaggttaattttgttgagcttgggactcttggggaaaacaagataagcacagtcaaggcttctactgttactgaaccacctgccaaggtgacagatgtgagctgccaagagcaaatccagggggcaggatttgttccttcagtagtatctgaggagaataagacagatgcagccaatagatacactgcagtggctgacaaaccaagtaaaaggagtaatgatggaaaaagtaaaaaggttaaaaatagttctcctgagaagcacattctggagaataagatagatgcaacaaaaatacatgttcccatggaaaccacaggggaccagggaattgaaggaatggcctatatggacgaaaatagaaatattacatttacctgtcccagaacaccatcagagctgataaataaatcatctcctctagaggttctggaatcagcagcctgtgaaaaactgcccactcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaacaccagaaatccagtcagatttcttacatagcaaagtcgaagctcctccttcagaggtggcggatacgttagtaataatgactgcttccaagggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagg

SEQ ID NO: 18125 - DNA, 1533 bp, Homo sapiens
aagaattggctcacttcagcaacagcagcagcaactctgggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggaatagccaggccagaagaaggaaggcctgtggtgagtgggacaggaaatgacatcaccaccccaccgaacaaggagctcccaccaagcccagagaagaaaacaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggagga

SEQ ID NO: 18126 - DNA, 2743 bp, Homo sapiens
cccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctccaccttactaaaatctaaataatgatagatattttaagtttttaaattgagtagttctgagtaatcctagaatatttttccaaattaaataatcctttattatttgcaagttgggccaaatttttttttttttggagacggactcttaacaatctaagattgtttcaacaggactttcttattcccattcctaattttttcaaactaattgcttaaatctagaaccagttgagattagtactgtacaatggtatgctttgattgtatttatagaaatataacataaaacatggaccatgttttgaaatcttagaggaattctggtttaaaatctgaaatactttaaagttttctatccttttactgattatgcagcttcttataacccccaaggtacagattatttcagcttaaaagaaataattggcaccatgttctgagaaagattttgagatatacattgttttttgtttttgagacagggtctcactcttgcctaggctggagtgcggtggcgcgatcttggcttactgcaccctctgcctcccaggttcaagtggttctcctgcctcagcctcccaagtagctgggattataggtgtgcgccaccacaccagctaatttttgtatttttagtagagacggggttttactttgttggccaggctggtctcgaactcctgatctcaagtgatccacccgccttggccacccaaagtgctgggattacaggtgtgagacactgtgcctggccagatatacattgttttagatcccctgatacagaactacttttgagatggtaagattagaatatcatgaaagtttaaactgaatccttgcagcgacttccggaatttaggaagcattccctcttctacaggggtctggtcacaagggctggattctctgacaaaaatttcttctatggattctggacagaagacacttgagggtgatatgttttaaaggaaagaggttatgcttatcttcttagcagttgataaaatattaaaactctcttgccatagagaatacaccatcaaagaaaacacaaccctttccctttggtgtacagttatttattaagttgattttggggtttctttcgccagggatcttttcaaaactggtagtagttatttttaaaaatcatgtttgacatctttctattgctcgtaaccagtccctgtagctgtctaagttatgggtggagaagcctgggtatgactttccgttgtgtacactcacacttcatgattgacatttatttattcttttatttccatttggttatgcttatttttgtttgaaatttgtttttttcaaatatgtttcctttttgaacttacagaattgttgaaattttctactaacagccagctaaaatttggtatatgttagctctatctgtttcacttggacgtttcattttgaaagaaagaaattttatgtttcacatatagttttatacaaagtagccagtcccataatgaaatgctgtattgccatagtggtcacacccaagtggtccagtatctcaatggtgaggcagccagactggtcagggctgctttgttgaaatgtgatgattttcatatgccttctttctctttctctctctctttttttttccttttttggcccaatgttgaagatgtagaactttgtttttaaataatgtttttataatttcattcgtatacctaagtttgtattttttgtgactttggacttcaacagtttgtatattgggacttctaatgtgattactgtactaaataaattccactaataaacatcttacattaa

SEQ ID NO: 18127 - DNA, 6762 bp, Homo sapiens
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 18128 - DNA, 2363 bp, Homo sapiens
tcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgt

SEQ ID NO: 18129 - DNA, 5724 bp, Homo sapiens
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 18130 - DNA, 6816 bp, Homo sapiens
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctgcgactaagcaagtccagagaagaccaccccctgcagggcccagatctgagagaggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 18131 - DNA, 5629 bp, Homo sapiens
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagcgtgaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 18132 - DNA, 5811 bp, Homo sapiens
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 18133 - DNA, 1499 bp, Homo sapiens
ttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaa

SEQ ID NO: 18134 - DNA, 2331 bp, Homo sapiens
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctgcgactaagcaagtccagagaagaccaccccctgcagggcccagatctgagagaggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 18135 - DNA, 1239 bp, Homo sapiens
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 18136 - DNA, 4958 bp, Homo sapiens
actcgggaggctgagggggctgatggtaaaacgaagatcgccacaccgaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 18137 - DNA, 5362 bp, Homo sapiens
cccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaataa

SEQ ID NO: 18138 - DNA, 5718 bp, Homo sapiens
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 18139 - DNA, 2623 bp, Homo sapiens
ctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccgaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacacctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 18140 - DNA, 6202 bp, Homo sapiens
agagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacagtttccttagcggcccctggtcacatgtcatcgggctgggcaggaagcgtccctgattgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaatctgcctggagttacagattcttaaatttttatgctgaagcttcccttttcagtcagcatgtgaataggaatagatttgtgtggatttacacatctacccacattttattatgatttccccggggcgggggttgtctttgtttttattgatggccaatgttgttaacaagagttacagactcgtatttgatatcaaatgtagcagctataataccttttaaaaactttaccaaaaaaaaaaaaaaaaagacataaagagaaaacattcccttgggaaacattccacctgcaagcaaacagaatcctagctcctgcaggtccagcatactccatctggacaagacagtgctgggcaaataggaaactgtgggagaagcaggcagatgtttctaagtacagctttgtggcagaatgacctgcttgacaaaaaccctttgaataagtgtttgttgactttaaacggcaatgatttatcgacatgagctataattgtaataacaatttaacagatacaggaataggtgaaaagagaaatgtatttcaactggcccagtaatcacctgtggagactgcagagcaggccacactgggatgcagacgttaccctggagcctgcaggttactgggcttcagctaatacccttttcaccgtgaagagtgccagccttccctacgctgcttccaagcaccacctagaggccagtttggtttctctactgtcctttggccactattttccagtcacttgcctttaggcacatttctattaaaataagtgggaaaataacagaaagcaaagatgttacccctcttctccatctacattcatttcctcccaaggtacaccacttgtgacagaagtttgtgagccattacctgggtttgaaatttcatgctcaaagtacatgtgtgtttcccatttaatccacgaactctggggttttaaacacttgatcttagacatttgtgcacagacaaaaatacatgtgattcatcttacaaaatgtacactggtggactctagtaaatctgtcactgatggttcaaaggtggcgaaataacatgcttgttctattttattaaatctgacatcatttctaaaaatttgttgcttctggtactatggataggctcaagtccagagacaccccttctcaaaaaagttaatggaattccattgaatttgagttacaaaatgccagttctctaaaacacacacagacaacttggtttctgacttgttttattccttttaactgctagaacacaactatgatcattaattaaggctgctatcactagtaataacttttactgacccagtttctcagcactgaggcaatgttgccaaatagcacaaatgatggataaaaacatctccgtggatgtctaatagctcctgtcttgccaaactaggaactcataaaagatgttttccactcattagaggaatcctggctttatttgcctaaaggaaagcaaagctgaggagaaaatccattgatccctggaggaccctcacgtggcattggtactttggatcacaagactgccccacgggcagaccccccaactctgagccagaccccatgtcttgtatagattacgagtacacagaaggtgcatttactgaggctgtgcttctgttttgggtttacaaatgtcatcaaaatggaagacccagctgaagttaatttgttggatgcctttttctctcaattcactggaaaaaaaaaatgtttaactttttagcttccaagttttaatttctaaaacaggtttcttgtggtattttgcaacgattttatcatcaagcctggtgataaattgtttttaaagggtaatgatgtattaatgtacctttgaatttacgattctcagtaggaaactaacccaagacctaaatgttttcttttctagagaataaaaaagttaagtacatgtttc

SEQ ID NO: 18141 - DNA, 3121 bp, Homo sapiens
ctctcgggtggactcccggagcggcggcggcggcggcggtggcagactgcgagtcacgtgcgacagaggaggcggagcacggcggccgggtgggtggagaaaacaaagcccccagctgtcagcagaggaaggaggcgacagcgccggagcagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagca

SEQ ID NO: 18142 - DNA, 3267 bp, Homo sapiens
gtagacccgctaggcaggaagaggtcactaaaaatactatcgtgctgtcaatgtagaatgaagggttaagcgctcaaacccgcgcccgcgcgcaccgaaacggaagaacttccttgattagcatagtatcgaccctggggccgcgctgcgaggcggaggttcggtcccagctggggtgaagtgtgcagaccggttgcgattgtggtcagacgcagcacctacttctaatctgaggacccgcgatttacacttttgctgaataggacactgtggaatgaaacagaacagagatcaaaagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagca

SEQ ID NO: 18143 - DNA, 2401 bp, Homo sapiens
gagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaac

SEQ ID NO: 18144 - DNA, 1892 bp, Homo sapiens
agcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcacgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggccgcagccctggctgactgcacagcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 18145 - DNA, 1001 bp, Homo sapiens
caggggtaggggtagcaattttgcagattttccaaacaggtgacttcagcccccgggcctgggcaggaaggggtagcccagtgacaatgggcatagtcccacttcaggaacgggaaacgtgttggctggctctgtggagttctctctcttctgatcccacagcatctgttccagttgtcttggccgctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcacgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggc

SEQ ID NO: 18146 - DNA, 1801 bp, Homo sapiens
ctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcacgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggccgcagccctggctgactgcacagcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 18147 - DNA, 878 bp, Homo sapiens
caagcccagaataacctggatgtgtgactcacaggggtaggggtagcaattttgcagattttccaaacaggtgacttcagcccccgggcctgggcaggaaggggtagcccagtgacaatgggcatagtcccacttcaggaacgggaaacgtgttggctggctctgtggagttctctctcttctgatcccacagcatctgttccagttgtcttggccgctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcacgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatggg

SEQ ID NO: 18148 - DNA, 6463 bp, Homo sapiens
gattggcgaagctcctccgcggcccaagccagccacctacaacgtctctgagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaccctctgtctctgcctgtctctgttgccttttcatcattttgtgtttttgcagttatgatgttgacaaatatttattcaacatctaccatttattcatactactttatgacatataattcattttcttttactgtctctcatccactatttgcctttccctattcaaaatacaattcttttgcaacactcaaaatattctccagggaatttttaaaacacaataaaagaaagcctatatagaagtg

SEQ ID NO: 18149 - DNA, 6044 bp, Homo sapiens
gaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 18150 - DNA, 6195 bp, Homo sapiens
ccctttcttctttatctcggtgtctgaggagttttgtctgcggcttgtcttgctacatttcttggttccctgaccaggaagcgaggtgattaacagacggttgaggcagctccttaggtggctttagcctgccctgtggaacatccctgcgggggactccaaccagccggagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 18151 - DNA, 5902 bp, Homo sapiens
atttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 18152 - DNA, 6092 bp, Homo sapiens
cccagcctgcttgaaggacctacaggtttgtctcttccagatcagaactgaggaacaaaaacccccatcctgggaaaaatggggaagctgatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 18153 - DNA, 5973 bp, Homo sapiens
acttgccccagcccagcctgcttgaaggacctacaggtttgtctcttccagatcagaactgaggaacaaaaacccccatcctgggaaaaatggggaagctgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 18154 - DNA, 1729 bp, Homo sapiens
ctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagcc

SEQ ID NO: 18155 - DNA, 945 bp, Homo sapiens
gagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtg

SEQ ID NO: 18156 - DNA, 6393 bp, Homo sapiens
gattctatgcagggtcactatgaaagaggcagcctgccccagtttgggtattctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaccctctgtctctgcctgtctctgttgccttttcatcattttgtgtttttgcagttatgatgttgacaaatatttattcaacatctaccatttattcatactactttatgacatataattcattttcttttactgtctctcatccactatttgcctttccctattcaaaatacaattcttttgcaacactcaaaatattctccagggaatttttaaaacacaataaaagaaagcctatatagaagtg

SEQ ID NO: 18157 - DNA, 5666 bp, Homo sapiens
atggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 18158 - DNA, 2876 bp, Homo sapiens
gagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaagcaaactctggagatgaacctcaccaacctggttaagcgcaacagcgaactagaaaatcaaatggccaaactaatacagatctgccagcaggttgaggtgaatactgctatgcatgaggcaaaacttatggaagaatgtgacgagttggtagagatcatccagcagaggaagcaaatgatcgctgtcaaaatcaaagagacaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagagggtcgctatggcaactgcatcttctcaagttctgattccagacatcaattttaatgatgcctttgaaaactttgctttagatttttccagagaaaagaaactgctagaggggttagattatttaacagccccaaacccaccatctatccgagaagaactctgtactgcctcccatgacaccattacagtccactggatctcggatgatgagttcagcatcagctcctatgagcttcagtacaccatattcactggccaggctaacttcatcagtaagtcatggtgtagttggggcctgtggccagagataaggaaatgtaaggaagcagtaagctgctcaagattggccggggcgccacgaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaataa

SEQ ID NO: 18159 - DNA, 2251 bp, Homo sapiens
acctgggaacgctatgggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaagcaaactctggagatgaacctcaccaacctggttaagcgcaacagcgaactagaaaatcaaatggccaaactaatacagatctgccagcaggttgaggtgaatactgctatgcatgaggcaaaacttatggaagaatgtgacgagttggtagagatcatccagcagaggaagcaaatgatcgctgtcaaaatcaaagagacaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagagggtcgctatggcaactgcatcttctcaagttctgattccagacatcaattttaatgatgcctttgaaaactttgctttagatttttccagagaaaagaaactgctagaggggttagattatttaacagccccaaacccaccatctatccgagaagaactctgtactgcctcccatgacaccattacagtccactggatctcggatgatgagttcagcatcagctcctatgagcttcagtacaccatattcactggccaggctaacttcatcagcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaataa

SEQ ID NO: 18160 - DNA, 758 bp, Homo sapiens
cttcaagatgacagggcgctggagaaaaggctgctggaatcagctggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaact

SEQ ID NO: 18161 - DNA, 3790 bp, Homo sapiens
gataaaggctgagggccgcgcgcttggcccagaccggcccggccagcgcgcattcggccccggacgaaggtactcgcagcacttggagcgcagaaccggccgcgcccgatcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacccggctcagttcggggaagctgcaggagttcggcgtgggtgatggcagcaagctgaccttggtacccaccgtggaagcgggcctcatgtctcaggcctcaaggccggaacagtccgtgatgcaagctctcgagagtctcacggagacgcaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccgccgccgctgctgcgcggggggaccccagcatagcctcccccgtgtcctcgccctgccggccggtgtccagtgccgcccgagtccccccggtgcccaccagcccgtcccctgcatctccctcgcccatcacagccggctccttccggtcccacgcagcctccaccacctgcccggagcagatggactgctcccccacggccagcagcagtgccagtcctggtgccagcaccacgtctaccccaggggccagccctgccccccgctcccgaaaacccggcgccgtcatcgagagctttgtgaatcacgccccgggggtcttctcagggaccttctctggcacgctacaccccaactgccaagacagcagcgggcggccgcggcgtgacatcggcaccatcctgcagatcctgaacgacctcctgagcgccacccggcactaccagggcatgcccccttcgctggcccagctccgctgccacgcccagtgctccccggcctcaccggcccccgacctggcccccagaactacctcctgcgagaagctcacggctgccccctcagcctccctgctgcagggccagagccagatccgcatgtgcaagcccccgggggaccggcttcggcagacagaaaaccgcgccacgcgctgcaaggtggaacggctgcagctgcttctgcagcagaaacggctccgtagaaaggcccggcgggacgcgcggggtccgtaccactggtcacccagccgcaaggccggccgcagcgacagcagtagcagcgggggcggcggcagccccagcgaggcctccggcttgggcctcgacttcgaggactccgtgtggaagccagaagtcaaccctgacatcaagtcagagttcgtggtggcttaggatcttcggatcggccaccctcgcccctcgcaccccagcccagggcggcggggactccgagagccccggagagaacgtggcccagccctggagggcaggcggccactcccccagccagaagtctttttttcttttcttcttttttattatttttttctttttttaaaaagttctgaccgtggtttcctggactcttcatgggctttgcttcctacctccttcacccttcactcctgccctcctcttcctcctcctcctcctcctccgtctgtctcctttcacctctgcgccaggtcggtcctccctgccaaccttccccagctccaatatgtagcagtctctctggatggcggagagtgaaggagacggagaaacgcgccccatcccttccgccgcctcctttcccccccgaccctattcaggttttaagtcaaaaatgtcgatatgtcattatgcactttacagatgaggggaggggccgcagtgcgcagaacccaccccaccccccagtgcagacttcggggtctccaccccaggccagcagcgcccactgggctacagcaagccaacaggtcacagaagccaacgaggggactgtttctcttccactcctatcctcttttcttgatcttttttttgcattttccttcatttctttaacaaggagagcaaagctgttttagcagaggctggggctgaggtccccatggggtttgggtgcaggggcatggcaccctttcctgtcgggaagggagaggggaactacccccccagcctgccctccgccccgccccagccggcggactgtgctgtttcctccgcccccactcccgtgttttctgacctcctgcctgagtttggggtatttatagactattaattttctgactgagccaatagtggttggggaactcttgaaaaaggggagagaatggctgggtgctggggagttcccccctccgagccctccttcccggcccaacctgagggatgtggatttgggactgtctgggggcccctcctgcagcgaggatgggagggggtgctgagctgtgaatcccctgggcagggggcgacaactccgtgtagcattaacccccgtggcggggtccgctgctggtctaatttggaccccctgcctctcagtgcccctgccctaggggtgtctgtctccagaggggagggacaaatcccctactggggccatttcaatggggtagtttttggatttttttccccactcactttttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgtagcgctgtaaatttttttgtgggagggtgggcagggaggggtcccagagggtagagctcaaggattttgggttttgttttgttttcatttttccaaaaaaaaaagaaaaaaaaatagaaaaaaaaggagtaaaaggggcgggtttgttttttgaagaactgtcttggatacctatttaaatgtgtgttctgttttgttttttaacgatttttaaataacgtctgtgcctccactggttgagggtggaacctccaggcaggaaccggctcgccaccctctgcccggtaagggctgcccaagaaagcattacccgccctcggggggtcgggctgtgggggtcccggcacctggcgtgagtttcatgtatgaaaacataaaattgaaaaaaaaaaaaaaacctacacgagcaccgtgatttcaagtaataaacagaaaatgaaac

SEQ ID NO: 18162 - DNA, 1408 bp, Homo sapiens
cccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagttgcctgctttgagacagaagatggagaatattccgtttgccagaggagctatagtaattgctctcgcctgatgccttcccgctgtaacacgcagtacagagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatact

SEQ ID NO: 18163 - DNA, 1256 bp, Homo sapiens
gggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatac

SEQ ID NO: 18164 - DNA, 1419 bp, Homo sapiens
cgggccccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagccccgtctcttgaatgcacagttgcctgctttgagacagaagatggagaatattccgtttgccagaggagctatagtaattgctctcgcctgatgccttcccgctgtaacacgcagtacagagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataa

SEQ ID NO: 18165 - DNA, 1937 bp, Homo sapiens
tgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagc

SEQ ID NO: 18166 - DNA, 1987 bp, Homo sapiens
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggggtgatgtggccttttccagaaggaggaaacaccatacctatcttacacacagatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggg

SEQ ID NO: 18167 - DNA, 1752 bp, Homo sapiens
ccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagct

SEQ ID NO: 18168 - DNA, 4113 bp, Homo sapiens
tgaggcgcgggaggcccgcgccccgcggctcgctgtgcgtgggagggcgcgagcgaacgcgggcgaggagcggccgagccgctgaagaggagctgggcgccggccgcccggccgcgctcggcccgcggatcgcctccgcccggtcttcgccggccccggcccctggcgagatgccgtgtggggaggattggctcagccacccgctgggaatcgtgcagggattcttcgcccaaaatggagttaatcctgactgggagaagaaagtaattgagtattttaaggaaaagctgaaggaaaataatgctcctaagtgggtaccatcactgaacgaagttccccttcattatttgaaacctaatagttttgtgaaatttcgttgcatgattcaggatatgtttgaccctgagttttacatgggagtttatgaaacggttaaccaaaacacaaaagcacatgttcttcattttggaaaatatagagatgtagcagagtgtgggcctcaacaagaacttgatttaaactctccacgaaataccactttggaaagacagactttctattgtgttccggtgcctggggaatctacgtgggtaaaagaagcctatgttaatgcaaaccaagctcgagtcagtccctcaacatcctacactcctagtcgccacaagaggagttatgaagatgatgacgatatggacctacagcccaataagcagaaagaccaacatgcaggtgccagacaagcagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtttatgaagattgggattgtttcaaagtaaatgacattcttgagctatatggcatactgtctgtggatcctgtgctgagtatactgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctgtaagtttgtttcaagtttcatgtccgaattgtctccagtcagagcagaacttcttgggttccttactcatgcccttctgggggatagtttggctgctgaataccttatattacatctcatctccacagtatatacaagaagagatgtccttccactaggaaaatttacagttaacttgagtggttgcccacggaatagtaccttcacagaacacttgtatcgaattattcaacatcttgttccagcatcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataatgttgctgattgtaccatttccttagcttcagctgagtcataggccagactgttgaaatgctgaaatgaagaaggttgttgcagtttcaaagtcagaggaatcgtgcttcggatttcttatgttttctagttctctgtttttccagttcacagtgggttggggtgcattcagtagtccatctttggggaacggaggcgtacttgccattgattcacatgactacatgaaattctgtactgtcatttcccagatgtttggccacagaaactttttcccacttaacatttgttaacagcctgcaaaactaaacttgtacatggcagtggttcccagacttttgtattttatggaccggtagtaatatttccaaaaatctggggtactataaggttgccaatttaccttgccaagtaatccgaataaatcactgtattatcaccatttttttcataaaaggaaaggacaatctatctctgaataagaggagtcctttaaacggaatgaatgtggcttttgggggcaaaagaaaccaagacactacattgtctttattttctcctatcccagtgcatttgagaaccatgcataagggaatgctgtgctacaaagctgtgcccaaatatgaaaacaaaataggaaacttaaaaagcaataccccctttagaaagtttttattttcttaaatgtcattgagttgctttgattctattggatttttggcattttttatgggatcatcagttggttccaagtatgttagatcagctaacatctgctactccagtaacagcctcgtacaactgcaggtaggttttctccagaccaattagttttaatagagcaaactaacaacagactgtagtagcatggttatggcaaccagaatcttcagaaaggttaggacattactttttaagctgtcagtggtatcaaataacttacctagttggaggcagataaaggatcccttacgttttttcctataaggcctaaattgaaattgttaaccaaggaaacagggtcagccttgaaaaatcaaggaattcattgtacctaataactgaagtaaaaataactagttgttcaacttttcctaaactcaaatctatttttataaacaaatgtaaataatgtttatattagagttgaactggttttcatttttataactggtagactagaccttccttaaacttttagaaataaaatgaaggcttcactggatttgtgaggataaaatacattttctttaattgtcctagagcaaagtacattagtcaccatgtgttttttgtgccaatgtaaattgtaatttaccaaagaaaaatacatacattgcttggtcttgcagaaaagttcccttgaaagaacctttccaataaataaaacgtcccaaattagcagtaccttgggctgtttttcatgagtaagaagattcaccatcccatgtgatctgtgtggaaaaagaccatgtcctcttggtggaagacatgagagagctgaactgaagtggaggaggtggtgcaagagggaccttcctgctcaaggcccgcccaggcagcggaatggagtgcagtgcttggctgcagaaaccctttgtccctcacctatatatacacggacagtcaagtttgttgctctaacgtaaggcacagcgttaatcctgtatggccaggaaactgagtagactcctgtgtaaccctgtttggaactttgccttcttaaaatgatttttc

SEQ ID NO: 18169 - DNA, 2465 bp, Homo sapiens
cccgccattgtgcgaagtgaaggctaggggcccgtacgcgcccgcctgactgtcgccagcagctcctcggcggccccaccgcagccgccgctccctgaggcgcgggaggcccgcgccccgcggctcgctgtgcgtgggagggcgcgagcgaacgcgggcgaggagcggccgagccgctgaagaggagctgggcgccggccgcccggccgcgctcggcccgcggatcgcctccgcccggtcttcgccggccccggcccctggcgagatgccgtgtggggaggattggctcagccacccgctgggaatcgtgcagggattcttcgcccaaaatggagttaatcctgactgggagaagaaagtaattgagtattttaaggaaaagctgaaggaaaataatgctcctaagtgggtaccatcactgaacgaagttccccttcattatttgaaacctaatagttttgtgaaatttcgttgcatgattcaggatatgtttgaccctgagttttacatgggagtttatgaaacggttaaccaaaacacaaaagcacatgttcttcattttggaaaatatagagatgtagcagagtgtgggcctcaacaagaacttgatttaaactctccacgaaataccactttggaaagacagactttctattgtgttccggtgcctggggaatctacgtgggtaaaagaagcctatgttaatgcaaaccaagctcgagtcagtccctcaacatcctacactcctagtcgccacaagaggagttatgaagatgatgacgatatggacctacagcccaataagcagaaagaccaacatgcaggtgccagacaagcagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtttatgaagattgggattgtttcaaagtaaatgacattcttgagctatatggcatactgtctgtggatcctgtgctgagtatactgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctttgtttcaagtttcatgtccgaattgtctccagtcagagcagaacttcttgggttccttactcatgcccttctgggggatagtttggctgctgaataccttatattacatctcatctccacagtatatacaagaagagatgtccttccactaggaaaatttacagttaacttgagtggttgcccacggaatagtaccttcacagaacacttgtatcgaattattcaacatcttgttccagcatcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataa

SEQ ID NO: 18170 - DNA, 4546 bp, Homo sapiens
ggttggaattttggcgggttcagctgtgaacgaagaaggcgtcccggcatcggccaagattctacattgctcatctgggcatctgagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgtagagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattcaattctgttatctctgttttactctttgaaattgatcaagccactgaatcactttgcatttcagtttatatatatagagagaaagaaggtgtctgctcttacattattgtggagccctgtgatagaaatatgtaaaatctcatattattttttttttaatttttttattttttatgacagggtctcactatgtcaccctggctggagtgcagtagtgcgatcgcggcacactgcagccttggcttccctgggctcaagcagtcctcccacctcagtctcccaaatagctaggactacaggcgtgcgtgaccaagcccagctaatttttgcattttttgtagagatggggttttgccatgttgctcaggctggtctcaaactcctgagcactagcaatccacccacctctgtttccaaaaaaaaaaaaaaaatgaaaggtcaacccctatgcaaattaccacagcaaaggtttcattcaggagattcttccatctgggcaacctggttttccaaatatcatttgacctaagtgaatgttgatactagctaaagattgggtaaattggttgaattattgtattgaagcttgagctgtagctaaaagtaatttaggtttcccctaagatgttattatgttagggacataacacttttgggaggttgttgtgggagatggttgatttaggttttcaaaagctagaaataaaatttacatgccttagatttcataaaattctgctctaattgggtggaaggtgctgtatctaacttgtgttcctcctaaggttatgtcctaataactattcttttaggagtatacttctactttatagaaggttgcttttctttttaattttttctaacaaagaaaagaataaagtatttattaataagaaccagaaagcacttgaaactgatgtttttaatggctcatttagggtagatttatttatctcattaacttaaaacagctatgtgtatgaaataggtcacaacagaacttgaacaccaggttggtgtctgagcaatccctttcttatgggaaaaacaatgttcttgtttgaacagagggtatcattgcagtcagtattcacgtgtatattgttatataagttgtataatatgcttgtaaaggctgagggtgagctgtatctggatgcctttttacaatttgattttaacttttaaaataaatttaaaac

SEQ ID NO: 18171 - DNA, 4587 bp, Homo sapiens
ccaagattctacattgctcatctgggcatctgagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggtatgccatttgcgtactaatttttgactccttttagtgacccatgctaataatgtggaaccatctcctattaaaatattttcatttttctaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattcaattctgttatctctgttttactctttgaaattgatcaagccactgaatcactttgcatttcagtttatatatatagagagaaagaaggtgtctgctcttacattattgtggagccctgtgatagaaatatgtaaaatctcatattattttttttttaatttttttattttttatgacagggtctcactatgtcaccctggctggagtgcagtagtgcgatcgcggcacactgcagccttggcttccctgggctcaagcagtcctcccacctcagtctcccaaatagctaggactacaggcgtgcgtgaccaagcccagctaatttttgcattttttgtagagatggggttttgccatgttgctcaggctggtctcaaactcctgagcactagcaatccacccacctctgtttccaaaaaaaaaaaaaaaatgaaaggtcaacccctatgcaaattaccacagcaaaggtttcattcaggagattcttccatctgggcaacctggttttccaaatatcatttgacctaagtgaatgttgatactagctaaagattgggtaaattggttgaattattgtattgaagcttgagctgtagctaaaagtaatttaggtttcccctaagatgttattatgttagggacataacacttttgggaggttgttgtgggagatggttgatttaggttttcaaaagctagaaataaaatttacatgccttagatttcataaaattctgctctaattgggtggaaggtgctgtatctaacttgtgttcctcctaaggttatgtcctaataactattcttttaggagtatacttctactttatagaaggttgcttttctttttaattttttctaacaaagaaaagaataaagtatttattaataagaaccagaaagcacttgaaactgatgtttttaatggctcatttagggtagatttatttatctcattaacttaaaacagctatgtgtatgaaataggtcacaacagaacttgaacaccaggttggtgtctgagcaatccctttcttatgggaaaaacaatgttcttgtttgaacagagggtatcattgcagtcagtattcacgtgtatattgttatataagttgtataatatgcttgtaaaggctgagggtgagctgtatctggatgcctttttacaatttgattttaacttttaaaataaatttaaaacataa

SEQ ID NO: 18172 - DNA, 4547 bp, Homo sapiens
ggttggaattttggcgggttcagctgtgaacgaagaaggcgtcccggcatcggccaagattctacattgctcatctgggcatctgagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattcaattctgttatctctgttttactctttgaaattgatcaagccactgaatcactttgcatttcagtttatatatatagagagaaagaaggtgtctgctcttacattattgtggagccctgtgatagaaatatgtaaaatctcatattattttttttttaatttttttattttttatgacagggtctcactatgtcaccctggctggagtgcagtagtgcgatcgcggcacactgcagccttggcttccctgggctcaagcagtcctcccacctcagtctcccaaatagctaggactacaggcgtgcgtgaccaagcccagctaatttttgcattttttgtagagatggggttttgccatgttgctcaggctggtctcaaactcctgagcactagcaatccacccacctctgtttccaaaaaaaaaaaaaaaatgaaaggtcaacccctatgcaaattaccacagcaaaggtttcattcaggagattcttccatctgggcaacctggttttccaaatatcatttgacctaagtgaatgttgatactagctaaagattgggtaaattggttgaattattgtattgaagcttgagctgtagctaaaagtaatttaggtttcccctaagatgttattatgttagggacataacacttttgggaggttgttgtgggagatggttgatttaggttttcaaaagctagaaataaaatttacatgccttagatttcataaaattctgctctaattgggtggaaggtgctgtatctaacttgtgttcctcctaaggttatgtcctaataactattcttttaggagtatacttctactttatagaaggttgcttttctttttaattttttctaacaaagaaaagaataaagtatttattaataagaaccagaaagcacttgaaactgatgtttttaatggctcatttagggtagatttatttatctcattaacttaaaacagctatgtgtatgaaataggtcacaacagaacttgaacaccaggttggtgtctgagcaatccctttcttatgggaaaaacaatgttcttgtttgaacagagggtatcattgcagtcagtattcacgtgtatattgttatataagttgtataatatgcttgtaaaggctgagggtgagctgtatctggatgcctttttacaatttgattttaacttttaaaataaatttaaaacataa

SEQ ID NO: 18173 - DNA, 3158 bp, Homo sapiens
gtgaacgaagaaggcgtcccggcatcgggccaagattctacattgctcatctgggcatctgagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgtagagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctg

SEQ ID NO: 18174 - DNA, 3736 bp, Homo sapiens
ggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctgaagttgtctattggatttctttctactgtaccctgattattacttccatctacttctgaatgtgagactttccctttttgcttaacctggagtgaagaggtagaactgtggtattatggatgaggtttctatgagaaggagtcattagagaactcatatgaaagctagaggccttagagatgactttccaaggttaattccagttgtttttttttttttttaagtttataaaagtttattatacttttttaaaattactctttagtaatttattttacttctgtgtcctaagggtaatttctcaggattgttttcaaattgcttttttaggggaaataggtcatttgctatattacaagcaatccccaaattttatggtcttccaggaaaagttattaccgtttatgatactaacagttcctgagacttagctatgatcagtatgttcatgaggtggagcagttcctgtgttgcagcttttaacaacagatggcattcattaaatcacaaagtatgttaaaggtcacaaaagcaaaataactgtctgaggctaaggcccacgtgggacagtctaatacccatgagtactcaacttgccttgatgtctgagctttccagtgcaatgtgaatttgagcagccagaaatctattagtagaaagcaagacagattaatataggttaaaacaatgatttaaatatgtttctcccaataattatctctttccctggaatcaacttgtatgaaaccttgtcaaaatgtactccacaagtatgtacaattaagtattttaaaaataaatggcaaacattaaaaacaa

SEQ ID NO: 18175 - DNA, 2957 bp, Homo sapiens
agtcccgtcagcttccggtagaagagctcggccacatcccggccgccactgtccccgcggactggcgggtggaaggactcagtgaaggatcctgcgacacaggctggccctgggcgcccctcccgcccggcccctccgccccttcccagccccaagggtctaggatacagtctttgtagatgagcgggtcccccttggaggacagaatgaagaattgggaaatcatggccgttctggagagtagacaagaagacggcgaaagtcgggcctgccccgccctgcggccccggaacaaaagaacgcgtgtgcgctggccctttaagagcgattctcctccgcccgcgccagctcggaccgcgggaaacccggcgcctgcactaccccgcccggagattcccttccgacgcccgcaccgcctccccgtcactcattctaggcccgcacggtgattggcttgcggctagcgggaggtgaagaaggccgccttgtccgattggcccgcacgcagtggcgccggtcacgtggggggcgacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaaggaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtc

SEQ ID NO: 18176 - DNA, 1968 bp, Homo sapiens
agtcccgtcagcttccggtagaagagctcggccacatcccggccgccactgtccccgcggactggcgggtggaaggactcagtgaaggatcctgcgacacaggctggccctgggcgcccctcccgcccggcccctccgccccttcccagccccaagggtctaggatacagtctttgtagatgagcgggtcccccttggaggacagaatgaagaattgggaaatcatggccgttctggagagtagacaagaagacggcgaaagtcgggcctgccccgccctgcggccccggaacaaaagaacgcgtgtgcgctggccctttaagagcgattctcctccgcccgcgccagctcggaccgcgggaaacccggcgcctgcactaccccgcccggagattcccttccgacgcccgcaccgcctccccgtcactcattctaggcccgcacggtgattggcttgcggctagcgggaggtgaagaaggccgccttgtccgattggcccgcacgcagtggcgccggtcacgtggggggcgacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaaggaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtca

SEQ ID NO: 18177 - DNA, 2900 bp, Homo sapiens
agtgtcgtgtaaacagtgtccttccgcgcggcggccgcggagagagctgcggcccgggggggcgtgcctgggatccggagcttcgctcgggcccgggaaaggcggcagtgggctgggatcgcggtgtctctgggtgtgatggccaatggctggactggctcccgccctgggcggaggaatcccgagctgtgaagcggctggaatccgggcccatgtgcttctttgtttactaagagcggaagcgatggcgggagcgggggtggggtgcggtggcggggtgcggtggcggaggtcccggtgaaatcaggggctaaggggacccaaagaaggcgggggatcataggggtggaaagaaagctgagaaccttgagaccggagtgtgaggggccaacggggaagggcgctagaattttaaactaaagtagggaccggaattcccctggggagatgttggatggccctgtgcactgccacgggctctttattcttcgctggttagaaacagacttgtgaaaaagagttatgcccactttggggagacttcgaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtc

SEQ ID NO: 18178 - DNA, 2321 bp, Homo sapiens
tcggttggccggccacagtccaccgcgcggagattctcagcttccccaggagcaagacctctgagcccgccaagcgcggccgcacggccctcggcagcgatggcactgaaggactacgcgctagagaaggaaaaggttaagaagttcttacaagagttctaccaggatgatgaactcgggaagaagcagttcaagtatgggaaccagttggttcggctggctcatcgggaacaggtggctctgtatgtggacctggacgacgtagcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtc

SEQ ID NO: 18179 - DNA, 2122 bp, Homo sapiens
atgaccccgagttggtggactcaatttgtgagaatgccaggcgctacgcgaagctctttgctgatgccgtactacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtc

SEQ ID NO: 18180 - DNA, 3442 bp, Homo sapiens
agggagggagaatccggccggacagatctgcgcgtatcctggagccggcccagttgtgaactaggagagctttgggacctctgtcccaagcaagtaagaactttagccttaggagatgtaaataaagtagtatttgaagaagcacaggagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgttttta

SEQ ID NO: 18181 - DNA, 3549 bp, Homo sapiens
ctttgagcggaagttggatcactgaagcgccaaaaaagaatttaggggaagacctgattttcgcttgaggcatttttgcggcgctgtgcgctacagacaccttctggaagctgcggtggggaaactgagtttcccgagccgttgagacagatggggttcagcaccgcgcggggacgacaggaaagctgcggctgaagagaactgcggacttggcaggagtcgcctgaggagctaagatcccggagactcttagccccgtggtgcttctctacgggagggagggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaagcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaat

SEQ ID NO: 18182 - DNA, 2859 bp, Homo sapiens
aactgcggacttggcaggagtcgcctgaggagctaagatcccggagactcttagccccgtggtgcttctctacgggagggagggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaaatggagtcttgctctgtcgcccaggctagagtacagtggtgcgatctcagctcactgcaacctccacctcccaagttcaaacagttctcccacctcagcctgccgagtagctgggactacaggcatgcgccaccagacccagctacttttgcttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgc

SEQ ID NO: 18183 - DNA, 3715 bp, Homo sapiens
ctttgagcggaagttggatcactgaagcgccaaaaaagaatttaggggaagacctgattttcgcttgaggcatttttgcggcgctgtgcgctacagacaccttctggaagctgcggtggggaaactgagtttcccgagccgttgagacagatggggttcagcaccgcgcggggacgacaggaaagctgcggctgaagagaactgcggacttggcaggagtcgcctgaggagctaagatcccggagactcttagccccgtggtgcttctctacgggagggagggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgttttta

SEQ ID NO: 18184 - DNA, 1181 bp, Homo sapiens
gcggcgctgtgcgctacagacaccttctggaagctgcggtggggaaactgagtttcccgagccgttgagacagatggggttcagcaccgcgcggggacgacaggaaagctgcggctgaagagaactgcggacttggcaggagtcgcctgaggagctaagatcccggagactcttagccccgtggtgcttctctacgggagggagggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatttcttaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgcctt

SEQ ID NO: 18185 - DNA, 7185 bp, Homo sapiens
cgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcagagtttggcttagagattaaagctccttctatcttgtgatgccaccatcgcaaggttctcaaggttgttgtgggagaagagaaggctaaaggagctcatagaatgcctttaatgctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaagttggaaaggctggtggatgtactgaggaagaaggttggaaccgggaccatgaggacagtgatctgattgaaaaaaaacgacagtctggggaagcgatcacatctggtgaccaggctgcttcattcaacactgtgtaaacaccaaagccttaacttagcaaacagttgttagaagtgggacactccaaccacattccaagctgagataaaatcaaatcacaaatgtttaaccactttgctgctgacttgagttatttatccaaatatattaactatagacttttaccaatgggtagctataaggttacagcttattttgtaactattttatatctcaatatctttaatataaatctttttactgagagatcattatagaaacatgttaaagttggttaggatcatatcttcacatatggccctttctgaatcaaagtgcggcaaagtaaatattgtctaagctttaatccactgtgttaggtcaaaacttcaaatacatgcatttttcaatatagggtatatttcttaactgatgagagaggcttagacatgagtgtgtagtcttccttcaatgcgtgtatgtaatctttgttagtataaaagatattaaatataggtgccaagaattaaatgtataatttgtttaataagagatggatatattaaaattacattcatcaaggcatgatttttgtttcactacaaataatgcaaactgttttcaataaaaagaggagactgttaatgtgtacttataaattcacattgtcagtattttttaatattgggtctgaataattatctgaattctacttaagctataagtctctgtcatttttgcttgaaaattagcatgcctctgtcttaaaagagaccatcaaacctattaagtattcttattgtttatctttttttaattgccatttgatttttattgtggaggaggaggatctaatatataatattcaatacaattgtaatgtagaaatataagaatttagaaaaaagtaaacttgccatttggttaaggttacctgctttttattttattccagaaataagatagttacagcatagcagtcatatgaagttatgaatagaactgagatttttatgtaattagttataggcaaaatactttcatatttttagattagacagacgaaagaccaagaggaaatgactgtgcctggaacaggatgaaatagacaagtagagatttaattagcaaaaattttgtagggaagtaaaattttttctaagtctatacgtttttaattcatctttaagattgagctaaattatctaccattgcctatttacaggataagtacattcaggacaatttattgtaccattctttcatataccatagcagattatccatttcaatttttttttactccacaggaaaatgtaagctactttgtcatagatcacaaaagaatcataatgctaacaaactctatttcttccttattaaatctgtatccattaaagtaacttttttaactatgagaattagaaaataagggacaacaggggttaaaaataaactgatttaatttgctctatagtcctaaagagaattatatcctctcatagaccaatgactctataatagagaaatatgtaatgatttggtcatgcatggagtcttgtctctgggctctatttgaaacgtgtaacagctccctatgtgaagaaacattatctttaaagtcatctgggaggtgcaggtaagtaaagagaaacaatttttgtcacaaagtagtccattcctgatctcacttaaaataaatcacaagtaaatttgaattttcggtttaatgttgaaagcagatgaacttttcttgagttattttgtcttttagaatacacaaaatatagtataaagacatttcacaatttccaaacaaatctttctacgcttaaatgatcaaattagaaaaaccaattcctataattaatatgcagaacttttatagaatatgatattataaagttaaatttgcaaaataattctaacatccactattgttcagtataggtaatctcccaaaaatatcacatcctcttgaaaatgaattgtctacaaaatttcaaatgcaaagtattacagccaaatattatcttaattaatttcttacacttaaaagtgtccatcaacagtgtgtcagatggtctttatatattttttctgtatgaaggaatagccttgcctactgaagataggttctctatgtattcaacaataatgcaactttagaagtattccacactgctgagaaatgttgctttgagtttgctttacacatcatcaactctaaatcctatagtaacatgagaattcacttcttcttgtaaaaataagtaatttacaggaaaggcaaaatgctaatactaacatttgtagcacttgatgatttacaaagtccttttacatctgttttttcatttgatcctatcgacaatcataataataataaattatatatataacccatataataacgatggtgatgataattttagtattactgtcattataattattattatattcattctacagatgaggaaacagactcagtaagccttggaatttgccaaggactggctaggacctagaactaagatcttataaccacactccatgcaactatgagtctctaaatctctctgtaagaaaaaaatttcaaagtaaagattttactcttgcaatttctgttgtgatagtaccatctctttcacatactacatacaaattccctaataatcaaaagattgtacacatttttttcaatgaagtacaataatgtgaactgcatgtgtaaacagcatcacattattaccacctctctatggtattatagtggcagtatgctttgcctcagccttcactaattaggaatattgtgacaattcattgctaataaaacataacatgagtctctttgtactgtttttaatttggcctgatgctaaaacctatcagcttagttttttaacatggtagtctaaacttcaaggcttgctctatctcctagagcaatttagagctaaaaccagtaataagcaaagttattggttataagcaaggtataagcagttaaagcaaagttattaattattaatatatgagaatttaaaattttataaataagttagaaattattaatgtattttaaatatggagtaaaatattttgctaatttttttcaatgataaagttgatcctttgtatatttccttattcaaataaattcagtcatcttcttatcaggttgcttatttatataatttgtttattttattaaaaatctagaatattaaagatttatacttttaatattgaatatagtttcgtagaaaaacattttatatgtactattcttaaagatcacaattatttttaaactttctattttcaaatacttgtgattaataaggcattctatgatgaaatagccatggcttatatatttttgtcttttcacatatgatgtgtttggaacccaaattttttactgattttattgtgttgttggtaactagtatttacagctaacctatctattcatattttacatatatatatatatatatacatgcacacacaccgatacatttaccttttaaaaaaatgatttataagtgaactgttaggctccagtgatttcagtgttttgttcatgttttattggaaatgcacgtggtttcttaggcttttaaacaaatacatggaatggttgaaagatttattttgctcgtgcttagctaaatatgtcatctctagaaaagatgtggtttgttttggcactgttttaaaaactcaaatattttaaacatttgttaagttggagcttgcacatttaaaccagcagcatacgttccagaagagcatctcaagttaccaaattttttgtaatccttttactagaaaaatcttttttgaagagtttttcttgtgcttgcttcggcagcatatatactgaaattagaaaaagaaaacttttcttttttattatatattttagtgtaagttaagttaaacttctaaaagttgaattatttaatgtaggacttcataaatagtatttgacaatgataaatgtgtatttttgagaatcattaaaatgtatacaatgatattcctttgcagaagtcttaatatgcataatttttaatctaattgtcttctaaatatagttttggtgtatgctggtattttagaagccaccaatttctggactatctgattattaacaaagatgtattttaatgcacaaactcaaatgtttaaaatatatatttactttgtactcaaataaaatcccctattgcaaatcctatacatatttcaatgcaattcttatacatcgatcttaatcaaatttataaatgtacaatcctgaagacagtgtactagatatgcactataaaatatattgcagtaaggaaacagattaagttcactgtcaaactgtctgacttccttaacaaatttaataaagataaatgtcaatatgaacaaatttgttaggtaccttaggaatctttcaaaactatttagatataaaataaaattatagtaataaaatattgaagagaaatatcatttttagtgaatatggttagaaagaacataagaagtgagatcaaattattttaattaaaaaaataggccaggtgcgatggctcacgcctgtaatcccagcattttgggaggccgaggcgggcggatcacaaggtcaggagattgagaccatcctggctaacacggtgaaaccccgtctctactaaaaaaagtacaaaaaagaagttagccgggcgtggtggcgggcgcctgtagtcccagctacttgggaggctgaggcaggagaatggcgtgaacccggaaggcagagcttgcagtgagccgagatcacgccattgcactccagcctgggtgacagagtgagactgtctcaaataataataataataataataataataataataataataatagactgactcaaatctaccataaagcacctctactcattttggaatatgtacgtggaattttgcttcaatagctgaaatctaaaaacactctttctgttgcatttgattattcaatcatgataaggtaaatgtaaacagactgtgtagcactctatcacctggagtgaacttagaatttacagcttagagtacatgactaaaagaggaatggagtggaagtgggcagtaggtgtctttggggcaaaaattctataaactggtgttatctaaactatcacattactttgttaaattattgtttcatcacgtatgacctttgtgatttgtcacacattttacttctacatatgcacataattgtaatttttttaactttaaaaagtcaattatgtttaagaaaatttttaaaataagaatgaacgtatgtgatatttactgtga

SEQ ID NO: 18186 - DNA, 1957 bp, Homo sapiens
tgccaggcgcatctcaggaacgaggtctcactatattgcccagactggtctcgaactcctgggctcaaacagtccccctgcgttggcctcccaaagtgatggaattacaggtgtgaatcactgcatctgactatggcaaggatctctgtcactgagagtttggcttagagattaaagctccttctatcttgtgatgccaccatcgcaaggttctcaaggttgttgtgggagaagagaaggctaaaggagctcatagaatgcctttaatgctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaagttggaaaggctggtggatgtactgaggaagaaggttggaaccgggaccatgaggacagtgatctgattgaaaaaaaacgacagtctggggaagcgatcacatctggtgaccaggctgcttcattcaacactgtgtaaacaccaaagccttaacttagcaaacagttgttagaagtgggacactccaaccacattccaagctgagataaaatcaaatcacaaatgttt

SEQ ID NO: 18187 - DNA, 1674 bp, Homo sapiens
cgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaagttggaaaggctggtggatgtactgaggaagaaggttggaaccgggaccatgaggacagtgatctgattgaaaaaaaacgacagtctggggaagcgatcacatctggtgaccaggctgcttcattcaacactgtgtaaacaccaaagccttaacttagcaaacagttgttagaagtgggacactccaaccacattccaagctgagataaaatcaaatcacaaatgtttaaccactttgctgctgacttgagttatttatccaaatatattaactatagacttttaccaatgggtagctataaggttacagcttattttgtaactattttatatctcaatatctttaatataaatctttttactgagagatcattatagaaacatgttaaagttggttaggatcatatcttcacatatggccctttctgaatcaaagtgcggcaaagtaaatattgtctaagctttaatccactgtgttaggtcaaaacttcaaatacatgcatttttcaatatagggtatatttcttaactgatgagagaggcttagacatgagtgtgtagtcttccttcaatgcgtgtatgtaatctttgttagtataaaagatattaaatataggtgccaagaattaaatgtataatttgtttaataagagatggatatattaaaattacattcatcaaggcatgatttttgtttcactacaaataatgcaaactgttttcaataaaaagaggagactgttaatgtgt

SEQ ID NO: 18188 - DNA, 2183 bp, Homo sapiens
ggaacgaggtctcactatattgcccagactggtctcgaactcctgggctcaaacagtccccctgcgttggcctcccaaagtgatggaattacaggtgtgaatcactgcatctgactatggcaaggatctctgtcactgagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaagttggaaaggctggtggatgtactgaggaagaaggttggaaccgggaccatgaggacagtgatctgattgaaaaaaaacgacagtctggggaagcgatcacatctggtgaccaggctgcttcattcaacactgtgtaaacaccaaagccttaacttagcaaacagttgttagaagtgggacactccaaccacattccaagctgagataaaatcaaatcacaaatgtttaaccactttgctgctgacttgagttatttatccaaatatattaactatagacttttaccaatgggtagctataaggttacagcttattttgtaactattttatatctcaatatctttaatataaatctttttactgagagatcattatagaaacatgttaaagttggttaggatcatatcttcacatatggccctttctgaatcaaagtgcggcaaagtaaatattgtctaagctttaatccactgtgttaggtcaaaacttcaaatacatgcatttttcaatatagggtatatttcttaactgatgagagaggcttagacatgagtgtgtagtcttccttcaatgcgtgtatgt

SEQ ID NO: 18189 - DNA, 2073 bp, Homo sapiens
ggaacgaggtctcactatattgcccagactggtctcgaactcctgggctcaaacagtccccctgcgttggcctcccaaagtgatggaattacaggtgtgaatcactgcatctgactatggcaaggatctctgtcactgagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaaatctcaaatacaaatctatttcattccaaataaaaaagatgaaagagaaaaattcctaatggataaaagaagaaagattgttgcacattcaaaacagaattcttgatagatacaaaatcatccaataaacttcagctagttttcagcattatatgcagttgatttgtccattcctcagtggaacttccaaatcatctaaaccagctttgtatgacactaagaataccctcattccttcagtgtctagctctgtgctgtgtttatttgcagaggaccctcatgcatggatccatataaatgaggcaaactgtgaagcagactagactgtgccgcttaccgtaaagtctttgagagaggaagattgtgtatatgaaaactgctaggcatgatatttacttataaggaagatttctatgtgtataacatcaagcaagatttttggttgaggttttatgctttcagtaaagaaaataaaagaagaaaacc

SEQ ID NO: 18190 - DNA, 732 bp, Homo sapiens
ccctgcggcgcgccgccgccccgtaggccccacgcgccgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcagctaatccaaaagtaaatgagaaacttagaaaaagattgccaattccaaatcaacatatttagagaaaattggaaaaggagaagcttactacagctttatttgaggactttttaaagaacgctgggttctatctgtgagtttatttatctagagttggctttattttagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttact

SEQ ID NO: 18191 - DNA, 775 bp, Homo sapiens
atgccaggcgcatctcaggtaaacggttgggcagggaggtttgggcgacggagaatgatagtggtgggcacagatcagccctggagttttcggccgcagacttttccttggagaaggagaaggggccccgcggaatctgtacttagtgaatgctgaccccgcgtggccgggagtgatggggctctctcgaagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaa

SEQ ID NO: 18192 - DNA, 4929 bp, Homo sapiens
agtgcgcggtcgctccgcgcctgcgcaggagaggtggtaggctcgggtggctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcaagctataagcgagcaattggtgaggactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccctctcctcttctagcccatgcccttccccggtggagggagggagcagggagccctcactctccacgccccttgcttgcatctgtatatagtgtgagcagcaagtaacccttctccctccccccccacccctcctcaatgtagtggccttggatatcctgtttgttaataaagacaattcaaccagctcccacc

SEQ ID NO: 18193 - DNA, 5016 bp, Homo sapiens
agtgcgcggtcgctccgcgcctgcgcaggagaggtggtaggctcgggtggctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagacctcgcagcaactccgcctggcaaatctatctgcaaaggcgggcagagcggggcaccccaaagcctccagggccccctgctcagccccctggcccgcccaacgcctctagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccctctcctcttctagcccatgcccttccccggtggagggagggagcagggagccctcactctccacgccccttgcttgcatctgtatatagtgtgagcagcaagtaacccttctccctccccccccacccctcctcaatgtagtggccttggatatcctgtttgttaataaagacaattcaaccagctcccacc

SEQ ID NO: 18194 - DNA, 4956 bp, Homo sapiens
agtgcgcggtcgctccgcgcctgcgcaggagaggtggtaggctcgggtggctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagacctcgcagcaactccgcctggcaaatctatctgcaaaggcgggcagagcggggcaccccaaagcctccagggccccctgctcagccccctggcccgcccaacgcctctagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccctctcctcttctagcccatgcccttccccggtggagggagggagcagggagccctcactctccacgccccttgcttgcatctgtatatagtgtgagcagcaagtaacccttctccctccccccccacccctcctcaatgtagtggccttggatatcctgtttgttaataaagacaattcaaccagctcccacc

SEQ ID NO: 18195 - DNA, 1907 bp, Homo sapiens
gtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctggggcagggaccatttcttcattttctgaaagcactttaatgattccccttcccccaaactccagggaatggaggggggaccccgccagccaaaacattccccccattcccgacccccctctcctcttctagcccatgcccttccccggtggagggagggagcagggagccctcactctccacgccccttgcttgcatctgtatatagtgtgagcagcaagtaacccttctccctccccccccacccctcctcaatgtagtggccttggatatcctgtttgttaataaagacaattcaaccagctccc

SEQ ID NO: 18196 - DNA, 4941 bp, Homo sapiens
gtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggctttatggttccagttcttctaccattctggaagctccctagaatctcctggaatgcttaatggacctttccagcaccgaaattcaagaattatgactcatcggtcagcagaaaagaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccctctcctcttctagcccatgcccttccccggtggagggagggagcagggagccctcactctccacgccccttgcttgcatctgtatatagtgtgagcagcaagtaacccttctccctccccccccacccctcctcaatgtagtggccttggatatcctgtttgttaataaagacaattcaaccagc

SEQ ID NO: 18197 - DNA, 2170 bp, Homo sapiens
agctgagccaccacctcccactccccgcgccgccccccagaaggacgcactgctctgattggcccggaagggttcaggagctgcccagcctttgggctcggggccaaaggccgcaccttcccccagcggccccgggcgaccagcgcgctccggccttgccgccgccacctcgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggttttggcttgtgatcaaccaggagggaaacatggttactgctcgccaggaacctcgcctggtcctgatttccctgacctgcgatggtgacaccctgactctcagtgcagcctacacaaaggacctactactgcctatcaaaacgcccaccacaaatgcagtgcacaagtgcagagtgcacggcctggagatagagggcagggactgtggcgaggccaccgcccagtggataaccagcttcctgaagtcacagccctaccgcctggtgcacttcgagcctcacatgcgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggattcttgggatgagcttcttattggtgacgtggaactgaaaagggtgatggcttgttccagatgcattttaaccacagtggacccagacaccggtgtcatgagcaggaaggaaccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatatcctagaatgtgttattgcccctgttcatgaggtacgcaatgaaaattaaattgcaccccaaatatggctggaatgccacttcccttttcttctcaagccccgggctagcttttgaaatggcataaagactgaggtgaccttcaggaagcactgcagatattaattttccatagatctggatctggccctgctgcttctcagacagcattggatttcctaaaggtgctcaggaggatggttgtgtagtcatggaggacccctggatccttgccattcccctcagctaatgacggagtgctccttctccagttccgggtgaaaaagttctgaattctgtggaggagaagaaaagtgattcagtgatttcagatagactactgaaaacctttaaagggggaaaaggaaagcatatgtcagttgtttaaaacccaatatctattttttaactgattgtataactctaagatctgatgaagtatattttttattgccattttgtcctttgattatattgggaagttgactaaacttgaaaaatgtttttaaaactgtgaataaatggaagctactttga

SEQ ID NO: 18198 - DNA, 1335 bp, Homo sapiens
cgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaa

SEQ ID NO: 18199 - DNA, 2127 bp, Homo sapiens
ggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgcaaaaatgtttttaaaatgtgtgccttttattacctatcagtctatgttttgggagaaatgggaagcaacagatcactgtgtcctgatgtgcaggacgcatgttaccacactcacaaatgcctaatattggtctttatgtggccattgagtcctgttgactttccactcatgtgctttttactctagcattatggaatctgggctgtacttgagtatggaaattctcttatagacttagttttagtactctattacacctttactaagccacataaaagtaatctgtttgtgtgtaactgccagatataccacctggaattccaagtaagataaggaagaggatgacatttaaaagagaatggaattttgagagtaggaatgcaaggaagacagcatgaacatatttttttcagtgcaaataattttttcgtaacaaagaaacgaacaactttggtatgatcttaagcaaaaatactcactgaaatagtatgtggatgaattcacctacttacaattttatggtttctttgtaaataataaatgtgaatctcaatcc

SEQ ID NO: 18200 - DNA, 585 bp, Homo sapiens
ggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtaaggagcctagctagaccccaggactgtggtgtggcccattcattggttcctaagcatcacctaaccc

SEQ ID NO: 18201 - DNA, 575 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtag

SEQ ID NO: 18202 - DNA, 1450 bp, Homo sapiens
atgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactag

SEQ ID NO: 18203 - DNA, 1707 bp, Homo sapiens
gctgcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccagggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtacacctggcccctctccgaagccccttgtccctttcttggggattgtggaggctgggtcagaggggagttaagggactgca

SEQ ID NO: 18204 - DNA, 4237 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtacacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacatgggccgagcgcagtggctcacgcctgtaatcccagcactttgggaggccaaggtgggcagatcgcctgaggtctggagttcaagaccagcctggccaacagggtgaaaccccgtctctacaaaaataagaaaattagccaggtgtagtggcagacgtctgtaatcccagctattcaggaggctgaggcacgagaattccatgaacccaggatgcggaggttgcagtgagccgagattgtgccactgcgctccagcctgggcgacagagtggtattctgtttc

SEQ ID NO: 18205 - DNA, 2874 bp, Homo sapiens
agttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagtagagatggggttttgccatgttggccagaatggttttgaactcctgacctcaagttatctacctgcctcagcctcccaaagtgccgagattatagccgtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggttttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttgaa

SEQ ID NO: 18206 - DNA, 2949 bp, Homo sapiens
ggcgccgtttccagttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggttttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttgaa

SEQ ID NO: 18207 - DNA, 3224 bp, Homo sapiens
cttcgttcttaacagccctgccccaaggctccctgaacggagccagatggaagttgtcccctttccctcctcctccgggcgggttggggagttctgagttgccgcggccgccttgtgtgtgccaggagagtggcagtgccatgctgctgggagctgccccggagagcagcccaggaccccggcggggccgcccctcgtcctctctcgtccccgaggggtcgggcaggaaggaaaatcaaactttattcccctctgtgacttcctctgtgtgtgtgcatggggaaccggctccctcgagatggatgctgcattgcttcaggaggcaagcttcatcctcttgggtccttaaaggtgcttttgggggtcctttcgagggctactgtataagcgtgttcacgcgtgcctgaagcgggaagggtggtcagcaggcacaggagaagcgaatatggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggttttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttg

SEQ ID NO: 18208 - DNA, 2587 bp, Homo sapiens
ggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccatacagttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatgt

SEQ ID NO: 18209 - DNA, 1443 bp, Homo sapiens
gacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaag

SEQ ID NO: 18210 - DNA, 955 bp, Homo sapiens
aaacactagatcaaaaaaaaaaaatcacagacctgtggtaggctgggcaccagtgctctaaagcaagttctgcctaaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctccctgccaggtcacccgccatggtcctccctctgccctggctctctcggtaccatttccttcgcctccttctgccctcctggtccttggcaccccagggctcccatgggtgctgctcccaaaaccccaaagcaagcatggaagagcagaccagctccagaggaaatgggaagatgacgtcccctcccaggggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccaagagagccttggaggaggcgcctaagtttcccccagtgcccacagcaccctccggcgctgaaaatacacgcaccacccaccaggagccttgggatcataaacaccccagcgtcttcccaggccagagaaagtggaagagaccacaaagcgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccaca

SEQ ID NO: 18211 - DNA, 955 bp, Homo sapiens
aaacactagatcaaaaaaaaaaaatcacagacctgtggtaggctgggcaccagtgctctaaagcaagttctgcctaaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctcccggccaggtcacccgccatggtcctccctctgccctggctctctcggtaccatttccttcgcctccttctgccctcctggtccttggcaccccagggctcccatgggtgctgctcccaaaaccccaaagcaagcatggaagagcagaccaactccagaggaaatgggaagatgacgtcccctcccaggggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccaagagagccttggaggaggtgcctaagtttcccccagtgcccacagcaccctccggcactgaaaatacacgcaccacccaccaggagccttgggatcataaacaccccagcgtcttcccaggccagagaaagtggaagagaccacaaaccgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccaca

SEQ ID NO: 18212 - DNA, 955 bp, Homo sapiens
aaacactagatcaaaaaaaaaaaatcacagacctgtggtaggctgggcaccagtgctctaaagcaagttctgcctgaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctcccggccaggtcacccgccatggtcctccctctgccctggctctctcggtaccatttccttcgcctccttctgccctcctggtccttggcaccccagggctcccatgggtgctgctcccaaaaccccaaagcaagcatggaagagcagaccaactccagaggaaatgggaagatgacgtcccctcccaggggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccaagagagccttggaggaggtgcctaagtttcccccagtgcccacagcaccctccggcactgaaaatacacgcaccacccaccaggagccttgggatcataaacaccccagcgtcttcccaggccagagaaagtggaagagaccacaaaccgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccaca

SEQ ID NO: 18213 - DNA, 955 bp, Homo sapiens
aaacactagatcaaaaaaaaaaaatcacagacctgtggtaggctgggcaccagtgctctaaagcaagttctgcctaaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctccctgccaggtcacccgccatggtcctccctctgccctggctctctcggtaccatttccttcgcctccttctgccctcctggtccttggcaccccagggctcccatgggtgctgctcccaaaaccccaaagcaagcatggaagagcagaccagctccagaggaaatgggaagatgacgtcccctcccaggggccctgggacccaccgcacagctgagctggcccgagctgaagagttgttggagcagcagctggagctgtaccaggccctccttgaagggcaggagggggcctgggaggcccaagccctggtgctcaagatccagaagctgaaggaacagatgaggaggcaccaagagagccttggaggaggcgcctaagtttcccccagtgcccacagcaccctccggcgctgaaaatacacgcaccacccaccaggagccttgggatcataaacaccccagcgtcttcccaggccagagaaagtggaagagaccacaaagcgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccaca

SEQ ID NO: 18214 - DNA, 955 bp, Homo sapiens; identical to SEQ ID NO: 18210

SEQ ID NO: 18215 - DNA, 955 bp, Homo sapiens
aaacactagatcaaaaaaaaaaaatcacagacctgtggtaggctgggcaccagtgctctaaagcaagttctgcctaaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctcccggccaggtcacccgcgatggtcctccctctgccctggctctctcggtaccatttccttcgcctccttctgccctcctggtccttggcaccccagggctcccatgggtgctgctcccaaaaccccaaagcaagcatggaaaagcagaccaactccagaggaaatgggaagatgacgtcccctcccaggggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccaagagagccttggaggaggtgcctaagtttcccccagtgcccacagcaccctccggcactgaaaatacacgcaccacccaccaggagccttgggatcataaacaccccagcgtcttcccaggccagagaaagtggaagagaccacaaaccgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccaca

SEQ ID NO: 18216 - DNA, 955 bp, Homo sapiens; identical to SEQ ID NO: 18211

SEQ ID NO: 18217 - DNA, 955 bp, Homo sapiens; identical to SEQ ID NO: 18211

SEQ ID NO: 18218 - DNA, 2436 bp, Homo sapiens
atcgctgggcgactgatttcgagtttccggtcaggttaggccgggggggtgcggtcctggtcggaaggaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagctccaggaaaatgcgtgccttatgctgttatagaaggagctgtgcggtctgttaaagaaacgcttaacagccagtttgtggaaaactgcaagggggtaattcagcggctgacacttcaggagcacaagatggtgtggaatcgaaccacccacctttggaatgattgctcaaagatcattcatcagaggaccaacacagtgccctttgacctggtgccccacgaggatggcgtggatgtggctgtgcgagtgctgaagcccctggactcagtggatctgggtctagagactgtgtatgagaagttccacccctcgattcagtccttcaccgatgtcatcggccactacatcagcggtgagcggcccaaaggcatccaagagaccgaggagatgctgaaggtgggggccaccctcacaggggttggcgaactggtcctggacaacaactctgtccgcctgcagccgcccaaacaaggcatgcagtactatctaagcagccaggacttcgacagcctgctgcagaggcaggagtcgagcgtcaggctctggaaggtgctggcgctggtttttggctttgccacatgtgccaccctcttcttcattctccggaagcagtatctgcagcggcaggagcgcctgcgcctcaagcagatgcaggaggagttccaggagcatgaggcccagctgctgagccgagccaagcctgaggacagggagagtctgaagagcgcctgtgtagtgtgtctgagcagcttcaagtcctgcgtctttctggagtgtgggcacgtttgttcctgcaccgagtgctaccgcgccttgccagagcccaagaagtgccctatctgcagacaggcgatcacccgggtgatacccctgtacaacagctaatagtttggaagccgcacagcttgacctggaagcacccctgcccccttttcagggatttttatctcgaggcctttggaggagcagtggtgggggtagctgtcacctccaggtatgattgagggaggaattgggtagaaactctccagacccatgcctccaatggcaggatgctgcctttcccacctgagaggggaccctgtccatgtgcagcctcatcagagcctcaccctgggaggatgccgtggcgtctcctcccaggagccagatcagtgcgagtgtgactgaaaatgcctcatcacttaagcaccaaagccagtgatcagcagctcttctgttcctgtgtcttctgtttttttctggtgaatcgttgcttgctgtggacttggtggaggactcagaggggaggaaaggctgggccccgagtacaacggatgccttgggtgctgcctccgaagagactctgccgcagcttttcttctttttcctcatgccccgggaaacagtctttcttcagaattgtcaggctgggcaggtcaacttgtgttcctttcccctcacctgcttgcctccttaacgcctgcacgtgtgtgtagaggacaaaagaaagtgaagtcagcacatccgcttctgcccagatggtcggggccccgggcaacagattgaagagagatcatgtgaagggcagttggtcaggcaggcctcctggtttcgccactggccctgatttgaactcctgccacttgggagagctcggggtggtccctggttttccctcctggagaatgaggcgcagaggcctcgcctcctgaaggacgcagtgtggatgccactggcctagtgtcctggcctcacagcttccttgcaaggctgtcacaaggaaaagcagccggctggcaccctgagcatatgccctcttggggctccctcatccagcccgtcgcagctttgacatcttggtgtactcatgtcgcttctccttgtgttaccccctcccagtattaccatttgcccctcacctgcccttggtgagccttttagtgcaagacagatggggctgttttcccccacctctgagtagttggaggtcacatacacagctctttttttattgcccttttctgcctctgaatgttcatctctcgtcctcctttgtgcaggcgaggaaggggtgccctcaggggccgacactagtatgatgcagtgtccagtgtgaacagcagaaattaaacatgttgcaacc

SEQ ID NO: 18219 - DNA, 2400 bp, Homo sapiens
cggcgtgggctgctgccttggaaacgcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccggggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaagaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatcctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggctgttgttcatgaatctgaaggattgttggggtacatttactgtgatttttttcagcgagcagacaaaccacatcaggattgccatttcactatccgtggaggcagactaaaggaagatggagactatcaactcccagttgtagttcttatgctgaatcttccccgttcctcaaggagttctccaactttgctaactcctagcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaatta

SEQ ID NO: 18220 - DNA, 1739 bp, Homo sapiens
cggcggccgaggcgatgagggtgttggtgcggcgctgttggggtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctatggcatattgaatgttcatcccagttgcctcccgagatggcgtggcccagcccctgtaatccatacagtgcttcacggagacacagttactggagtaacaattatgcaaattagacctaaaaggtttgatgtaggcccaattctcaaacaagaaactgttcctgtgccacccaagagcactgcaaaggaattggaagcagtgttgtcaagactgggtgccaacatgctcatttcagttttgaaaaatttgcctgaaagtctgagcaatggaaggcagcagccaatggagggggcgacttacgcccctaagatttctgctggtaccagttgtataaaatgggaggaacaaacttcagaacaaatattcagactttaccgtgccattggaaatataattccgttgcagacgctctggatggcgaataccattaaacttctggatttggtagaagttaacagttcagtccttgctgatccaaaattaacgggacaggctcttattccaggatcagtaatataccacaaacagtcacaaatactattggtttattgcaaggatggttggattggtgttcgatcagtgatgctcaagaaatcactaacagctactgacttctacaatggatatttgcacccctggtaccagaaaaattcccaagctcaaccaagccaatgcagatttcagactctcagacttccaacaaagaagaagcagaaaaaaactgttgctatgcaacaatgcattgagtagttaggaagaagatggataaaaacctattacatatttgtaatttattaaaaaccttatttacaaggaattatctggacttttttttttttttttttttttgagacagagtctcactctgtcacccaggctggaatccagtggcactatctcagctcactgcaacctccgcctcccaggttcaagcaattctcctgcctcagcctcctgagtagctgggattacaggcacacgccaccacacgcagctaatttttgtatttttagtagagatggggtttcaccatgttggtcaggctggtctcgaactcctgaccttgtgatctgcccacctcagcctcccaaagtgctatgattacagacgtgagccaccgtgcctggcctggaattatctggactttcaaagaagatggcattattataagaagagaagattattgccgaaaagatggattgcctcactttccactttttatgtaacagtagttaaaaaacagctttttttttacttgaattacaaaaaagtttaaataaaacttgtatttatgatacgaaactc

SEQ ID NO: 18221 - DNA, 1522 bp, Homo sapiens
gcgatgagggtgttggtgcggcgctgttggggtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctatggcatattgaatgttcatcccagttgcctcccgagatggcgtggcccagcccctgtaatccatacagtgcttcacggagacacagttactggagtaacaattatgcaaattagacctaaaaggtttgatgtaggcccaattctcaaacaagaaactgttcctgtgccacccaagagcactgcaaaggaattggaagcagtgttgtcaagactgggtgccaacatgctcatttcagttttgaaaaatttgcctgaaagtctgagcaatggaaggcagcagccaatggagggggcgacttacgcccctaagatttctgctggtaccagttgtataaaatgggaggaacaaacttcagaacaaatattcagactttaccgtgccattggaaatataattccgttgcagacgctctggatggcgaataccattaaacttctggatttggtagaagttaacagttcagtccttgctgatccaaaattaacgggacaggctcttattccaggatcagtaatataccacaaacagtcacaaatactattggtttattgcaaggatggttggattggtgttcgatcagtgatgctcaagaaatcactaacagctactgacttctacaatggatatttgcacccctggtaccagaaaaattcccaagctcaaccaagccaatgcagatttcagactctcagacttccaacaaagaagaagcagaaaaaaactgttgctatgcaacaatgcattgagtagttaggaagaagatggataaaaacctattacatatttgtaatttattaaaaaccttatttacaaggaattatctggacttttttttttttttttttttttgagacagagtctcactctgtcacccaggctggaatccagtggcactatctcagctcactgcaacctccgcctcccaggttcaagcaattctcctgcctcagcctcctgatgctatgattacagacgtgagccaccgtgcctggcctggaattatctggactttcaaagaagatggcattattataagaagagaagattattgccgaaaagatggattgcctcactttccactttttatgtaacagtagtt

SEQ ID NO: 18222 - DNA, 2572 bp, Homo sapiens
agcttcgcgctagtgctgttttttttttttttttttttttagcaatggcggttcccggcgtggggctcttgacccgtttgaacctgtgtgcccggagaagaactcgagtccagcggcctatcgtcaggcttttgagttgcccaggaactgtggccaaagaccttaggagagacgagcagccttcagggagcgtggagacaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttcaaaatttggtagtgctctcgaatatgtatatttgtatttttcaagcgaagttctcttattcacatataaattaaagtgggttggtactgatatcaaaaaatgtttatgtttttagaacagacatttcagtcactgcattcttaggtattccaaaccaaatatgatgacatcaatagattgcattttaaaaatattgtttgatttttctattttcaaaaataaaattctgtttctaact

SEQ ID NO: 18223 - DNA, 5947 bp, Homo sapiens
atggcatgggccaagaaggttgggggcagagcagggcagggcaggtcgctctcaagatgtgaccccattattttggatccagagtggctttatggacctcctgaaggagaaggtggacctgaaggagtgggtggagaaactagagcttcgatccatccacctctcaggacaggcagacaccatcagaaagtaaatcacaacatacgagggccagagggcagcgccaaagacgcggcaccaggaggaggaggacatcatcaggctggcccaggacaaagaggagatgaagatggggcattgcagcacctctgtgggggtgggggtggggtgggtgtgagcgtgggcaggggcactggcaccagcgtggcagctgagcacccctcccttcaggtgaaactgctggagctgcaggagctggtgttgcggcttgcaggcgatcacaacgaggggcatggcaaattcctggccgctgcccagaaccctgctgatgatcctgctccaggggccccagcccctcaggagcttggggctgctgacaagcagggtggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttcaaaatttggtagtgctctcgaatatgtatatttgtatttttcaagcgaagttctcttattcacatataaattaaagtgggttggtactgatatcaaaaaatgtttatgtttttagaacagacatttcagtcactgcattcttaggtattccaaaccaaatatgatgacatcaatagattgcattttaaaaatattgtttgatttttctattttcaaaaataaaattctgtttctaactaaaatgtgatattcccagtattccttcacatctcttttgagaactcccctcttcctgcaggaaagagacatatttgtctctcagtatatgcagaaaattggttccaggaccatccacgtacacccagatctgcacacactgaactccttcagtcctgtggagcccgtgcatgggagaattccaccttgcacataagcagattttgcatcctgtgaaagtactgtattttctttctttcttttttttttttttttttttttgagacagagtctcgctctgtcgcccaggctagagtgcagtggcgcaatctcggctcactgcaagctctgcctcccaggttcacgccattctcctgcctcagcctctctgagtagctgggactataggtgcccgccaccacgcccggacaatttttttgtatttttagtagagacagggtttcaccatggtctcgatctcccgacctcgtgatcagcccacctcaacctcccaaagtgctgggattacaagcgtgagccaccatgcctggccgagaatactgtattttcaatccaagtttggttggaaaaaatctgtgtgtaaatggacttcgcagttgaaacccatgttgttcaatgggcaactgtatattgaaatttaatttccattacattctctgtggagcaacttttttgctttgtttcgttttgtttctgagacggagttttgctcttgttgcccaggctggggtgcaatggcacaatctcagctcactgcaacctccgcctcccggattcaagtgattctcctgcctcagctgggattacaggcgcccaccaccaagcccagctaatttttgtagttttagtagggacagggtttcaccatgttggccaggctgatctcgaactcctgacctcaggtgatcgcccaccttggccttccaaagtgttggaattacaggcgtgagccactgcacctggcttctgtggagtaactttctatttaagaagcaagtaaggcctgggcatagcggcacatgcctgtagtcccaggtacttgggaggccgaggcacaaggactgcttgaacctgggaggcagaggctgcagtgagctgagatcacagcactgtactccatcctgggcgacagtgagactctctcaaaggaaaagaagcaagtagtatagtgtttaaaaacagacttgagcgagactggctcaatgacaagttactcagtctcttggggcccctgtttgatctgtaaaatggggatcatgatcagatcaatgtgaggattaagcgagggatgtaggaaaatgctaggtcagtgcattttcctggcgcgaagtaaatgttacttctctttaactgttgcctttcggtgtttgtggtatgtaattaccttttttgctactcaaaattcagatttagagtttgtagtactttaaaaatttttcccatttaaattttatgtcagaaattataatgggttctgcatgggatattttaagaaactcagcattgttatgaagcaaatgaattctgtgtccttgtgtctgtgctattggattgcacatttgacaccaacaaatatcagtgttctgtacaggcgatgtctttaaaagccatttttcatttgttctttattttgttgggctagaaatccatattgatttaaaaagcttaaaaagcataaaccacttaagggtttctaaatgaaatttttttttctgttcacagatatttagtcagatattttcttttttaggttggtgctaggtgtaatatggttatttaagcacataaagtatgtgtatgggttagcattttcttttctttttggtaatttgtaggacagccttgacactaggctgttttacttttcagaatcagatttaattatgtgattaattttaaatctacaaagacttgttttttgtttttttttttgagagcaaatcttgctctgtcacccaggctagactgcagtggtgcgatctcggctcactgcaacctctgcctcctgggttcaagcgatactcctgccccagcctcccaagtaactgggattacaggcgcctgccaccatgcctagctaatttttgtatgttagtagagacggggtttcaccatgttggccaggctggtcttgaattcctgacctcaagtgatctacctgtctcagcctctcaaagtgctgggattacaggttacaggtgtgagccaccgcacctggcctacaaagacccttttttttttttttttttgagatgggtctccctctgtcacccaggctggagagtgcagtgatcttggctcactgaaacctccacttcccgggttcaggtgattcttctgcctcagcctcctgagtagctgggattacaggtgcatgccaccacacctggctaagttttctatttttagtagagatggggttttactctgttggccaggctggtctcgaactcctgacctcaggtgacctgcccacctcgccctcccaaaatgctgggattacaggcatgagccaccacgcctggctgcaaagaccttttaatacacagttttaaagtctgttcaactgaatatagactacagacaaatatattttctcataactttagtgtatcacaacccagatttttaaaatatttttattacgtgatagtgataactagcaattatttgtcattgctgtttcttaattaaaaataattgcaatgttaagtaaaacttttttcaagtttttttcttctataactattactaggctttcattcagtagctttcacctgtaatgagttttactaagtatgtgaaagtaattttgataggagactacccagatcaaaacgatttcagctatagcccactagtataattcctggagctattatccatctttagaaaatttgagaattagccagagactttctaggaaataacgattagcctgaaacgttataggaaaactgtgtgtaattatctcattcaccttcagttaccataaaggagaagggaaaataaagttgagttgaaataaga

SEQ ID NO: 18224 - DNA, 816 bp, Homo sapiens
gatctctgtaggggaacccagggtcgccgccgttgctgaggcagaagtgagatgtgtgatgtttgtttggggcgactcctgtgtacagtaatggagttgtttagacttccatgaaattcaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatc

SEQ ID NO: 18225 - DNA, 695 bp, Homo sapiens
gaccttaggagagacgagcagccttcagggagcgtggagacaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtgtaagtttttaggtgtacctcaacttttagaactatgtatttttttatgaacaataaagattcctgtaaaatgttcaagctacattattgtttaatgggtatagatcttcagttttacaaggtgaaaagagttacggagatgaatcgtggtggtggatgcataatgagatgaaggaaagtttttttctatttctagctttctaagaatgtcgtcatgctcaacacattgagtagatgttgagttttgacatttg

SEQ ID NO: 18226 - DNA, 2246 bp, Homo sapiens
gcgagacgggtgcgcttacgccacggcgtctgctggcggccgcggagacgcagagtcttgagcagcgcggcaggcaccatgttcctgactgcgctcctctggcgcggccgcattcccggccgtcagtggatcgggaagcaccggcggccgcggttcgtgtcgttgcgcgccaagcagaacatgatccgccgcctggagatcgaggcggagaaccattactggctgagcatgccctacatgacccgggagcaggagcgcggccacgccgcggtgcgcaggagggaggccttcgaggccataaaggcggccgccacttccaagttccccccgcatagattcattgcggaccagctcgaccatctcaatgtcaccaagaaatggtcctaatcctgagtcgtcacccttggattttatggatcacggagctgaccatctttacctggtcctggaactgaaaaactgtagcttgtgtgaaaatgagcctttggaccagtctttattaaaacaaacaaacatgagtagtctgcatatcgaatatctagagctctaaacccccaatacttaaaagtctaattgctgtcctgtggtttcattagtctgataggaagatagggatttcctcagtcacagatgatattttgaaggaaagctgcaataaagccacaatgatttgaggtctttgcttaagtatgagatacttgatgggggctttatcatgcaacattagtttgcttaccttaagaattgcccaaaaatgaaagaaaatatgagcttttcagttaaacatactcctaaaaacattttccgggattttactactaaaattggacatttaagcgaagtaaaagaggccgggtgcggtggctcacgcctgtaatcccaacactttaggagtccaaggcgggcggatcacttgaggtcaggagttcaagaccagcttggccaaggtgataaaacccgtctctactaatacaaaaaaaattagctgggtatgttggtgcaggcttgcaatcccagctacttgggacgctgaggtgggaggatcgcctgaacctcagaggcagaggttgcaatgaagcggaggttgcagtgagccgagagcatgccgctgcactccagcctgggagactgcatctcaaaaaagaaaaataaacgaagtaaaagatatttatcagagctgttacaggaaggtgtattttttagctattttggcagggtgctgtggtgcttgcatgtagtcccagctattcaggaatattgcttgagtccagcttgggcaacatagcgagaccctatctaaaataacaataatatatggccaggcgggatggctcacgcctgtaatcccagcactttgggaggctgaggcgggcagatcacttgaggccaggagttcaagaccagcccaaccaacatggtgaaaccctgtctccactgaaaatacataaaattagccgggtgcagtggtgaggcctgtaatcccagctactcaggaggctgaggcaggagaatcgcttgcacccaggaggtggaggctgcagtaagtcgagattgtgtcactgcactctagcctgggcgacagaaaaagaaaatttaggtggggaaaaaaatcagaattgcgtctgtgggaacaggaataaaggagaaaccactattgactgggaagacacacaaagaactttgtcaaagttgtatggctgaggcccacacggtggctcacttctgtaatcccatcactttgggaggcttaggcagaaggatcacctgagatcaggagttccagaccagcctggccaacatggcgaaaccccatctctactaaaaatacaaaaattagccgggcgtggtggcttacgcctgtaatcccagcactttgggaggccaaggtgggcggatcacaaggtcaggagttcgagaccagcctggccaatatggtgaaaccccatctctactaaaaatataaaaatcagcaaaaaaaatttagccaggcttggtcatgcatgcctgtaatcctagctactgggaaggctgaggaaggagaattgcttgaacccaggtggtggaggttgcagtgagctgagatcgtgccactgctctccagcctgcatgacgggagtgagacaccatctcaaaaaatacatataataatataaataaaaatatcttttttgaaaataatttaatataccatgtaatttaccagttgaagatgttcgctttcagaatataataaaaatagtcaaaaa

SEQ ID NO: 18227 - DNA, 1490 bp, Homo sapiens
gtcgctctgagtacacttgcaggatcaaaaaagaaaaagaataagaaggaaggattaaaataatcacagcatcgccaacaggatcgtattttcccgaaggtggttaaccagccataccggaaccacgaaacacacagggtcctgggcaacacggaggactaacagtaacaccgccacgccggcagcaaagctcattttggtccccgccccgttcctctttctctttttaactccttccctctttgcggattctagaacggaacctttttttaattcttcccagtagaaacgtaggaacaatttcgtgaacgcaatccggagtgcccaacatggcggcggccgtaaggtgcatgggtagagccttgatacatcatcaaaggcatagcctttccaagatggtttatcagacatcactttgttcttgttctgtaaacatccgagtgcccaacagacattttgctgctgctacaaagtctgcaaagaaaacaaaaaaaggtgctaaagaaaaaacaccagatgagaaaaaagatgaaatagaaaaaataaaagcatatccctatatggaaggcgaacctgaggatgatgtctatttaaaacgcttatacccgagacagatatatgaggtggagaaagctgttcacttacttaagaaatttcaaattcttgactttactagtccaaagcaaagtgtttatcttgatttgacactggatatggcactgggaaagaagaaaaacgtggagccatttaccagtgttcttagtttgccatacccatttgcttccgaaatcaataaagttgctgtatttacagagaatgcatcagaggtcaaaatagcggaagaaaatggagctgcatttgcaggaggcactagtctgatacagaagatttgggatgatgaaattgttgcagacttttacgtagctgttccagaaataatgcctgaacttaatcgattaaggaagaaactgaataaaaaatatccaaagctttctcgaaattccattggccgtgacatccccaaaatgcttgaattatttaaaaatggacatgaaattaaggtagatgaagaaagggagaactttctccagaccaaaatagcaacattggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaacctgc

SEQ ID NO: 18228 - DNA, 983 bp, Homo sapiens
gagtgcccaacatggcggcggccgtaaggtgcatgggtagagccttgatacatcatcaaaggcatagcctttccaagatggtttatcagacatcactttgttcttgttctgtaaacatccgagtgcccaacagacattttgctgctgctacaaagtctgcaaagaaaacaaaaaaaggtgctaaagaaaaaacaccagatgagaaaaaagatgaaatagaaaaaataaaagcatatccctatatggaaggcgaacctgaggatgatgtctatttaaaacgcttatacccgagacagatatatgaggtggagaaagctgttcacttacttaagaaatttcaaattcttgactttactagtccaaagcaaagtgtttatcttgatttgacactggatatggcactgggaaagaagaaaaacgtggagccatttaccagtgttcttagtttgccatacccatttgcttccgaaatcaataaagttgctgtatttacagagaatgcatcagaggtcaaaatagcggaagaaaatggagctgcatttgcaggaggcactagtctgatacagaagatttgggatgatgaaattgttgcagacttttacgtagctgttccagaaataatgcctgaacttaatcgattaaggaagaaactgaataaaaaatatccaaagctttctcgaaattccattggccgtgacatccccaaaatgcttgaattatttaaaaatggacatgaaattaaggtagatgaagaaagggagaactttctccagaccaaaatagcaacattggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaaataaaaagccaaccaaaaaaaaaaaaaaac

SEQ ID NO: 18229 - DNA, 2013 bp, Homo sapiens
caagtgagctgcccaccttggcctcccaaagtgttgggattacaggcgtgagccaccacacccagcaaaatttctaacaagctctcaaatgatgctgatgttgctggttggggtggaggtggggcataccttgagagccactagattagaccaggggttggcgtattatggcagggccagtcactgtgttttataaaattctattggtacatagtttctgctgtctctttaaatattgtctgtggctgcttttggcagagttgagcattagagacagattacatgggccccaaacttaaaatatttactgtttgaccattttaagaaaaagtttatttaaccttatcccctttttctttctctctctctctctctctttccttccttccttccttccttctttttttttctgagacggagtcttactctgtgcccaggctagagtgcagtggcatgatctcggctcactgcaacctccacctcccgggttcaagcgattctcctgcctcagcctctcaagtagctgggattacaggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattct

SEQ ID NO: 18230 - DNA, 1725 bp, Homo sapiens
gtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattctacttcctttattttgtggtttacacggttgtcctccctctaaacttactctcaggggcttctctgtcatctgactttcctcactcttgcttcccttcctaggaaaatcctcttcccctatacctgttcccacaaatggcatcccgcgcatgcttgccctattaaaggcagctgacagctgtacccacta

SEQ ID NO: 18231 - DNA, 1622 bp, Homo sapiens
ttccgtccattcttccggtggagatggctgcggccgtggcggggatgctgcgagggggtctcctgccccaggcgggctagagtgcagtggcatgatctcggctcactgcaacctccacctcccgggttcaagcgattctcctgcctcagcctctcaagtagctgggattacaggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagca

SEQ ID NO: 18232 - DNA, 1605 bp, Homo sapiens
gtgaggacccttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccactgtcatcttctatcttgggacctcagggaagggaaccagtactggtggtagccaatatgggcagacattaggaaattggggtcttcatactgcttctcagatgtgcaaactgaggttcagccaagcaaagtaacttgcccaggtccttttttttcttttttaagttataattttgttttattgcccaggttctgaattggtgccagaggtaggaatagaacccaggccttctcatttgaaatcctgtgttcttcccctccccagggtgggaactatggttgctagggctgaggtgtattgcttacttcttccatcaaaaatctcttttatctctgaacaacttgccacctctgcagaaacaagtccctgtggagatctcagttcagccccaggcagggttactacatggagtacccagatcccaggggctacttcaggcccttctactaagctcctgaccctggctctgggtcagatgttggctgaacatgaactattgtagggctgacagctacagaccacagaaagagcaaagcttcagtaggttcctgcctgatggagaagtcctcgggaagcccttggccttctatttcctcattgtcctttcagagaagagagcaggagttgggggagaaaggagattcgcatttactgaccatctgttatgtgctagacacttcattttacactgagaaaatatggaaagcatagataaacacctaaaagaaaataaaaacctcatgttatcccaccaccca

SEQ ID NO: 18233 - DNA, 922 bp, Homo sapiens
cctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggaacgttgttctgcaaatgttctaagaaatggaaagatctccatgaaggatccaagtgggagaagttcagtgtgacctgggtctgtcgtcctagagcctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttctta

SEQ ID NO: 18234 - DNA, 1527 bp, Homo sapiens
gtgaggacccttgacctctggcccaagatggtggcgcccagagcttcgctcttgctgctcccctgaggtgaactgaagccagcagccccgcatcatgtcaaagctcggccgggccgcccggggcctcaggaagcccgagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccactgtcatcttctatcttgggacctcagggaagggaaccagtactggtggtagccaatatgggcagacattaggaaattggggtcttcatactgcttctcagatgtgcaaactgaggttcagccaagcaaagtaacttgcccaggtccttttttttcttttttaagttataattttgttttattgcccaggttctgaattggtgccagaggtaggaatagaacccaggccttctcatttgaaatcctgtgttcttcccctccccagggtgggaactatggttgctagggctgaggtgtattgcttacttcttccatcaaaaatctcttttatctctgaacaacttgccacctctgcagaaacaagtccctgtggagatctcagttcagccccaggcagggttactacatggagtacccagatcccaggggctacttcaggcccttctactaagctcctgaccctggctctgggtcagatgttggctgaacatgaactattgtagggctgacagctacagaccacagaaagagcaaagcttcagtaggttcctgcctgatggagaagtcctcgggaagcccttggccttctatttcctcattgtcctttcagagaagagagcaggagttgggggagaaaggagattcgcatttactgaccatctgttatgtgctagacacttcattttacactgagaaaatatggaaagcatagataaacacctaaaagaaaataaaaacctcatgttatcccaccaccca

SEQ ID NO: 18235 - DNA, 1945 bp, Homo sapiens
cgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgtgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcagccgctggtgacgagccccctcctcagggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgcc

SEQ ID NO: 18236 - DNA, 885 bp, Homo sapiens
cagcccgcggaccgatgctgccggcggccgctcgccccctgtgggggccttgccttgggcttcgggccgctgcgttccgccttgccaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaagaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatcaaggcatcaacctcgtccaggcaaagaagctggtggagtccctgcccaggaaatcaaagccaatgtcgccaaagctgaggcggagaagatcaaggcggccctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctc

SEQ ID NO: 18237 - DNA, 998 bp, Homo sapiens
gctcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgctcgccccctgtgggggccttgccttgggcttcgggccgctgcgttccgccttgccaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaagaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggcaaagaagctggtggagtccctgccccaggaaatcaaagccaatgtcgccaaagctgaggcggagaagatcaaggcggccctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctc

SEQ ID NO: 18238 - DNA, 1884 bp, Homo sapiens
cggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgtgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcaggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgcc

SEQ ID NO: 18239 - DNA, 1919 bp, Homo sapiens
ccggctcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgctcgccccctgtgggggccttgccttgggcttcgggccgctgcgttccgccttgccaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaagaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggcaaagaagctggtggagtccctgccccaggaaatcaaagccaatgtcgccaaagctgaggcggagaagatcaaggcggccctggaggcgacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgtgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcaggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctga

SEQ ID NO: 18240 - DNA, 1087 bp, Homo sapiens
cagcagcctttgaggggactggctttactaatgagcaacaatgctggtcgctgcgtgaaggccaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgtgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcaggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctct

SEQ ID NO: 18241 - DNA, 956 bp, Homo sapiens
atcgcgtccgccgggctgggcctggcgcgcaggcgctaggaagaggccgcgtggggcgaaggcggcgcttggctggtggggcccgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcatttatgtgtttttccagagctttctgggatgtgggaaaataaattacactgaagcagttgaaaggtggcttacccgagtctggccacacggggtagcattctttacatggagcagccttggtgccagggtctgagcccttgcttttctggtttggaccctataagttcatccaggactgtcaggccctggaaaactgaggtacacaccaaatgccaatttataaatgtaccatggctctaa

SEQ ID NO: 18242 - DNA, 1147 bp, Homo sapiens
acaaagcagcccccgagaccacgtggcctccgagcagctcagggcgcccttgaaagttcttggatctgcgggttatggccggtcccttgcagggcggtggggcccgggccctggacctactccggggcctgccgcgtgtgagcctggccaacttaaagccgaatcccggctccaagaaaccggagagaagaccaagaggtcggagaagaggtagaaaatgtggcagaggccataaaggagaaaggcaaagaggaacccggccccgcttgggctttgagggaggccagactccattttacatccgaatcccaaaatacgggtttaacgaaggacatagtttcagacgccagtataagcctttgagtctcaatagactgcagtatcttattgatttgggtcgtgttgatcctagtcaacctattgacttaacccagcttgtcaatgggagaggtgtgaccatccagccacttaaaagggattatggtgtccagctggttgaggagggtgctgacacctttacggcaaaagttaatattgaagtacagttggcttcagaactagctattgctgccattgaaaaaaatggtggtgttgttactacagccttctatgatccaagaagtctggacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagagaaa

SEQ ID NO: 18243 - DNA, 1182 bp, Homo sapiens
actcaacctcccccggaactcaacccccgtcgctcgagtttctttcgcttccgtcgggactctgcggagtggacccgagtgaacacaacttccggccccactgagcggtgtcctgagccgattacagctaggtagtggagcgccgctgcttacctgggtgcaggagacagccggagtcgctgggggagctccgcgccgccggacgcccgtgaccatgtggaggctgctggctcgcgctagtgcgccgctcctgcgggtgcccttgtcagattcctgggcactcctccccgccagtgctggcgtaaagacactgctcccagtaccaagttttgaagatgtttccattcctgaaaaacccaagcttagatttattgaaagggcaccacttgtgccaaaagtaagaagagaacctaaaaatttaagtgacatacggggaccttccactgaagctacggagtttacagaaggcaattttgcaatcttggcattgggtggtggctacctgcattggggccactttgaaatgatgcgcctgacaatcaaccgctctatggaccccaagaacatgtttgccatatggcgagtaccagcccctttcaagcccatcactcgcaaaagtgttgggcatcgcatggggggaggcaaaggtgctattgaccactacgtgacacctgtgaaggctggccgccttgttgtagagatgggtgggcgttgtgaatttgaagaagtgcaaggtttccttgaccaggttgcccacaagttgcccttcgcagcaaaggctgtgagccgcgggactctagagaagatgcgaaaagatcaagaggaaagagaacgtaacaaccagaacccctggacatttgagcgaatagccactgccaacatgctgggcatacggaaagtactgagcccatatgacttgacccacaaggggaaatactggggcaagttctacatgcccaaacgtgtgtagtgagtgtaggagataactgtatataggctactgaaagaaggattctgcatttctattcccctcagcctacccactgaagtctttgggtagctcttaagccataactaaggagcagcatttgagtagatttctgaaaaacaatgttatttgttgatttaaaaagaaaactgtatttttattaaataaaatttaaacatcacttcaggatataa

SEQ ID NO: 18244 - DNA, 1969 bp, Homo sapiens
accacgctccgagctaaggcgcatgcgttccctgaaattgccgccaccggctctaccttccagtttccagttccggcctccaaggggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatatatataaatttatttattttttccttcctgtgggatttctggagaatgagaattatccaaatgctcagtctacctgagatagtaaattcatggcttatgcttctggtccttaaatttgggttatttttggttagtgcaattttgtttttcttaatgccagtttacatgggaatgcatcctataattccaaatgttgccagaggtggttgtgttttgacatctggtctcctagagatgagtgcttgggatttcttagagaaagattacttcctgacaggggtaggggagtgacaatctgcaagtgaaacttccttaaacaatctagtaccctgcgaaccttcaggggatactgcaatcagtcctctgttttgaggcaggatcacacattaccttaatgtgttcccttcaaccccctgaatgggcctgggaggagaggacccaagaactcagatgttccaccagtttggccaaaggggtggagacattcagcagaggatgttgggctccaggataagctccttcctcttggtgaggggaaggggtaagaaagagggtctatgcgagagaaggattaggaaattaaacctcctaggaatttcctggaagtttttattgttgtcaaatctggcctctctgggaacccagaaaagggaaatccggcttcagaatgtgagaagctgggagcccctttcttggcacagccaggctgccgttcccttgggttcagaggctttagtagggtagtagttatggaaggacttagaaaggagccatcagtcttggtccaaacacttgatagcagtgcctgataattgccatatccccagtaaagtgggtagaagagattttatcttaggctctatcttctgagtgtatttggcccactgaacccatccactgtctgagataataagtaagagtaagggtaaagggatcactggtgtagcagacatggcttcagtgacagaacgaactattctggtgctaatttagctgtagctgccttagtctgatactcatctactcccaacagagctctttatctctttttctctactatggtttgttcttcacactatagccagaaagctcttatattttaaatgaaatatagtagacactcaaaacatttatgaaataaagctacaactc

SEQ ID NO: 18245 - DNA, 978 bp, Homo sapiens
ggagagtttggggatctacagcagccaaaggcttgtccctgactttatatggctgctcctggcgagcgactgagtcgtccgtgaggaaaaagaggcgaggcttttccgagatcgtctcagcgatggcgcttcggtcgcggttttgggggttgttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttattttctg

SEQ ID NO: 18246 - DNA, 3479 bp, Homo sapiens
gtagtcttgacgtgagctagctggcatggcggcctgcattgcagcggggcactgggctgcaatgggcctaggccggagtttccaagccgccaggactctgctccccccgccggcctctatcgcctgcagggtccacgcggggcctgtccggcagcagagcactgggccttccgagcccggtgcgttccaaccgccgccgaaaccggtcatcgtggacaagcaccgccccgtggaaccggaacgcaggttcttgagtcctgaattcattcctcgaaggggaagaacagatcctctgaaatttcaaatagaaagaaaagatatgttagaaaggagaaaagtactccacattccagagttctatgttggaagtattcttcgtgttactacagctgacccatatgccagtggaaaaatcagccagtttctggggatttgcattcagagatcaggaagaggacttggagctactttcatccttaggaatgttatcgaaggacaaggtgtcgagatttgctttgaactttataatcctcgggtccaggagattcaggtggtcaaattagagaaacggctggatgatagcttgctatacttacgagatgcccttcctgaatatagcacttttgatgtgaatatgaagccagtagtacaagagcctaaccaaaaagttcctgttaatgagctgaaagtaaaaatgaagcctaagccctggtctaaacgctgggaacgtccaaattttaatattaaaggaatcagatttgatctttgtttaactgaacagcaaatgaaagaagctcagaagtggaatcagccatggcttgaatttgatatgatgagggaatatgatacttcaaaaattgaagctgcaatatggaaggaaattgaagcgtcgaaaaggtcttgattctgagaatgaatttggttagttgcagaagatacattggctctaagaggatatattttgagaccaatttaatttcatttataagaacatagtaattaagtgaactaagcattcattgttttattaatactttttttctaaaataaaacttgtacaccagtttattactctaaaaagagaattacacatgccaaatggaccaatgtccatttgcttattggaggcaaagctacaatagaagtcagagcatcaccagaatggtctttaatgagcatggaacctgagcaaagggaataggtgggatgaattttttttttaattgtgaaacaattcataagcacaatatgatttacagaataataaacattcatgtacccactatcaggttaagaaatagaacatttattaatatgtaggaatgttaagaaataaaacatttaataagatctcagaagactccagtaaatctgcaattgtatctctctcctttttaaatgtaaatatcatcttgacttgttaattattcccttgcatttcttttagtttactgccaacacatatattcttcaacaatatatttaattttgaaaaacctgaaaaaaaaaacctgttagcaagtataaaggggcagtattactattattgcatgaaggcttcaagggaaacgttacagtctttgggtcatagtctggcttcagcttcctctgagagtttacagaggccaattttgagcaaattcatggctaaggttatgagtgagttctgctaaacagaaggctcaccacaaggtatctggcaggattatactgggtagctggatgttgcagaaatgtggttagaggaagtaaactgttttttgatgctcacagcatgatgaatcaaactctgtatcttaggattaggttaaaacaatacctttggtatgatatgagtgttgttgctgatccatgcagcatggattggaaagctggggtataagcacacatgctaaagaaaaacatgtaatttggtccatactcacctggatatactgttcctcaggttaaaaaatacagtactatcctaaatcttgaaggcaactctcagcctatccattgagttaccttcagatctgccctctggttcctagctgtcttgggactaacttctttcctgcgctcagctgttttctggattccatgttttccattttattgagtactaacttgttttgctgcagcacatcctttggtagcttctagaggaagtttgtgtggaggtaaaatttttgagaccttgcatgtctcatgtttgattgatactttatacgtttaggtaggaggtaattttccttcaggactttaaaaatattgttgctccattttctttgtttctattgttgtattgagaaatccaatgccattttgatttccccatcataaatttcatgatgatgtgtcttggtgtgggtctatatttatccattgtattgggttttaggtgaacccttccagatagtaactcatttctgtcagttctgggaaacacttagcattggttgatgatttattctctgctgctttgttctcccaactattatttggatgttggatatccagcactgggtatctattttcttacctccctcccttgaccccagtctctgttttttagctctttagctcaatcttccaactctttgctattgtattttaaaatcttaagaccccttcttgatttgtagaagttccttttcttacaaccaaaaagcctttatctatggatttgttcacagataaggggtattcaatatagtgtatttttttttcatttaaaattgtttgcgcatctatttcctccaaatttctttctgtatttattttttgttgtctatatttcagacttttccaggatatctgataatctttggctgtcttcttatggttgaaagagggactaaaaagcttggaaagcctttgggttgtgggaaggggctgtctttaggattatctgaatgggcttttttgggagtcccctcctccacatgaatattttggttttgtcagattccctagaatagaggcttccaatctccttcctggaggggtctgtccaggaaggagattgtctaggggtctgtcagacagcagctttcagctacttccttgatctttttcactaatgattatatagtcatctaactactgtcaacaagtaatagatatcctatccttcacttgtttagattatttgctgagataacctctcaaaagaacctctcaaaataaaaggttaacaagagcctatatcttatatttttcttctctttatcttgttagaagatagctattaaaacctgttctttttctgtcttgataaacacacttcaatcttggtagaatggtagatgggacagtatattttaggacctaaagctctgcaaatgtatgatcagcttgtaagtacaggtgctcaaaaacatgtaaacaatcatgctttttactctgtaggaatatctttaaaattcttgtgaatttttccccagaagtaaagcaaatcttcccccagaaataaaattaaatgtgcataatctaaa

SEQ ID NO: 18247 - DNA, 1076 bp, Homo sapiens
ctggcatggcggcctgcattgcagcggggcactgggctgcaatgggcctaggccggagtttccaagccgccaggactctgctccccccgccggcctctatcgcctgcagggtccacgcggggcctgtccggcagcagagcactgggccttccgagcccggtgcgttccaaccgccgccgaaaccggtcatcgtggacaagcaccgccccgtggaaccggaacgcaggttcttgagtcctgaattcattcctcgaaggggaagaacagatcctctgaaatttcaaatagaaagaaaagatatgttagaaaggagaaaagtactccacattccagagttctatgttggaagtattcttcgtgttactacagctgacccatatgccagtggaaaaatcagccagtttctggggatttgcattcagagatcaggaagaggacttggagctactttcatccttaggaatgttatcgaaggacaaggtgtcgagatttgctttgaactttataatcctcgggtccaggagattcaggtggtcaaattagagaaacggctggatgatagcttgctatacttacgagatgcccttcctgaatatagcacttttgatgtgaatatgaagccagtagtacaagagcctaaccaaaaagttcctgttaatgagctgaaagtaaaaatgaagcctaagccctggtctaaacgctgggaacgtccaaattttaatattaaaggaatcagatttgatctttgtttaactgaacagcaaatgaaagaagctcagaagtggaatcagccatggcttgaatttgatatgatgagggaatatgatacttcaaaaattgaagctgcaatatggaaggaaattgaagcgtcgaaaaggtcttgattctgagaatgaatttgccgggggccatcaagtataagaccacaggaccacgtgattcataaagaactactgtcaaaactagggccgccattaccaacatgtgaccttgagaaggcaatcaacgctgagagcttcattcctctgatacataaagatttataatcacctttgagtttgaagataacttggatt

SEQ ID NO: 18248 - DNA, 475 bp, Homo sapiens
aaagttcctgttaatgagctgaaagtaaaaatgaagcctaagccctggtctaaacgctgggaacgtccaaattttaatattaaaggaatcagatttgatctttgtttaactgaacagcaaatgaaagaagctcagaagtggaatcagccatggcttgaatttgatatgatgagggaatatgatacttcaaaaattgaagctgcaatatggaaggaaattgaagcgtcgaaaaggtcttgattctgagaatgaatttggtaccttcgagattcaatctcttctaaaatccactgagttttttcatctactgagaagtttccacttgtggatgtctcatctttgcctgttaataaataaaattgacttcatactacaaattctcaaaagaaaaaagtaaaatgctttgaaaataaaggtaatatcatggatgtataaacatatgcatatgtaaatacataaatatgcttaaattttg

SEQ ID NO: 18249 - DNA, 1588 bp, Homo sapiens
ttttggaggctggagttttgtaaggttggttggagggggtttgttcatctttctggtagtgcgagaataagagatggcagagaccttaaccttcagccccaggataccctcaaagactcacctgcaatctgccggtgtggctgccgctcttgccggtactgcccctttaaatccatgatggctgccgctcgaggcaattgttttgacgggtctgggggggcggggcctgtttcctagtcacgcgacattagagctgcccgcggattggctctcacggcgttcaggtaggaaaggaggtgtgtatccagcttgggctccagttttctgcccgcctccttttacgttattgcggagcgacggcgccggacagtcaacgtcatctaggagcaccgagcagcttggctaaaagtaagggtgtcgtgctgatggccctgtgcgcactgacccgcgctctgcgctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggtcagcagacatagctctggttgctgggggcagccggaaacgctggatcatcgccacagaaaacatgcaggctggagatacaatcttgaactctaaccacataggccgaatggcagttgctgctcgggaaggggatgcgcatcctcttggggctctgcctgtggggaccctcatcaacaacgtggaaagtgagccaggccggggtgcccaatatatccgagctgcagggacgtgtggtgtgctactgcggaaggtgaatggcacagccattatccagctgccctctaagaggcagatgcaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccccgttttaatctgttactgtggttttgttttgggtgttttttgttttttttgttgttgttttttttttgcgggggaggggatggtacagactaaacgtggggaaaagaagtaaaaagtgtggaagagaaagtacaggacactgggtctgtccccaccccaattcccttacaagtaatggagccggggatggaaataaatgacgtccaaggtc

SEQ ID NO: 18250 - DNA, 721 bp, Homo sapiens
cggaagcgctcgtgaccaccatttccgacccgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcag

SEQ ID NO: 18251 - DNA, 683 bp, Homo sapiens
ggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccaggatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaaggaga

SEQ ID NO: 18252 - DNA, 1263 bp, Homo sapiens
gtttccggccgaggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccaggatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaagtaagttagagaaagtaccgctgggccctgttgcacggtgctggttgcccaggcgcatgcggacggagggtgtggggcacgtgggtctcgggacaggaagcccaggcaggtctcaacctggctgccactgcccacttgccaccctcatcctagagggagcacccagagggtccagcctcgctccccttctcctccacgctccacgcgtgaccccacctcgctccccttctcctccacgctccgcacgtgaccccacctcgctccccttctcctccaccctccgcgcgtgaccccacctcgctccccttctcctccaccctccgcgcatgaccccacctcgctccccttctcctccaccctccgcgcgtgaccccacctcgctccccttctcctccaccctccgcgcgtgaccccacctcgctccccttctcctccaccctccgcgcgtgaccccacctcgctccccttctcctccaccctccgcgcgtgaccccacctcgctccccttctcctccaccctccacgcatgaccccactttgttccaacccatgacgcctagcactgtccccaaagcagcagtgaatccgcaagcaggtgtagggctgtcctagcaggtctgcactgaggacatcccccatagtgggcatcctgagggatggcacccacggggcatgggccacatagctg

SEQ ID NO: 18253 - DNA, 662 bp, Homo sapiens
accttagggcggctggcgtccgcgtgcagccacagcatcctgagaccttcggggcccggagcagcctccctttggtctgcttctcgaaggttcaattcacagagcacttcatatctaccagggtaatatcaaaatatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaaggaga

SEQ ID NO: 18254 - DNA, 3035 bp, Homo sapiens
gtagcgggagggcgaaagatggcggcggcagtactgggacagttgggtgcgttatggatacataacctgaggagccgggggaagctggccttggggaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaatgctttttatgatttctcattgaattattgaaacagtgtataactgctagttgtaaatgaatatttataaggctttgcccatttcttttgagcctctgggcatatttgtatgcatttgcgacttggaaggggaaatcagctttaaacatagtaacagactatatttcaaaaggcttttggagtaactttgaaagggaatgttaactttccaactagtgtcctgcaggtggctgttttgatactggacttgaatacagtgttatgaggtaagaaaattgcttttatttcacttaattttctcttgggaccatgggaagttagagtggctgcatgttgtttcattacagtattttagggtgttcagtggtaccgtttttcctttcactgttggcacaggccagtgagtcaaaaattatattttcctttactgttttagcagtaactcgaaactacaggagtttattagatatacgaatctaaaactccaaaaacctttaactttgaaaattttcttttggttaagcaaagcctgtttttatttcttcttccaacagtgctttatattgtttggatatcttgtttaggattgatttatttttcagggtaaattcaattactgagagaggaattgaaccaatctcagcattgcattctaaaatggggcagtaggtggcactcaaccttttattagcagaaaattgttagtttcaaattagagtgttcaacactgcttccctctcattcatacacgtcttcattaagaagaagtactctttgtctacagccctagtccaacttttgcatgcaaaagaagaatcgaggatgcttgcttgttaatgcagacttctgggccccaccccaatgattcaattcactaggtcttatggggggctggtttcagaaatctatgttttaaacaaacacttccaggtaattctgttgtaggggactacgctttgagaatacggctttaggagaatgaaaaaatgtagttttattgccatgttttaagatggcattaataatagttactgtttactgggaacttgttatttgcaagctctgtgctagtattttacataattcttcacaacatcctgaaaatgtagcttttgttttaccactttacaaaggaataaaccgaagcacacagaattcaaataactatcacaagtcacacagcatgtaaatattggggctatgattgaaaggtttctaaagtagctggttctgcataccttttgagtatacagctgggtttttgtgtctctccagttaacctaatgcatgggtaaaaagacatcaggggtcagtggaataaaccaaggtgtaggacagattcattctgggtcctaagctgttgtagcatggagtcagggaaataacactggaatattaaaaggtaaccttcattctagtctgtgcattctcattagccagaaagaagactggataggtctcttcccttgctggcctccatttcattcatttatgaaacaagagactcaatgttctctgtagaaaaccttttttagaatcacttgaagaatttgtttaaaaatgcaaattcctgggctctactctcagactaagtgaatcagaagctttggtgtgggagaccatggaacctgcagttttaataaatgccccagtgatttgcatgttggagaattatcacaccaggtcactgtgctctcatgtggtggggatgctccacgattgctcttggagttgtgacttccttgggtgtgactaaagccaggtggtgccatggacatcataaatataaattatgtaagtgaaggcactgcttcagtcaggctgtaaaagctattttgaaagtggtaaggaaaaagtaggattgtaatgaagaaaatttccttcccaggttaagccttcatttggaactgcttccagtacgttacaaaaagtaataatagctaacctgtgtcactgactgtatctggtactattttaagcactatatatacattatctcaatgaatctttcccattgtgacatccggctagttttcgtggctaagagtgtactttctaacatccatgaacattgtggtccccacctgaagtttcactttgcatgttcagtgatatggtttggctctgtgttcccacccaatcttatctcaaattgtaatccccatgtgtccagggagggacctgtaatccccacctagtgacggagggaggtgattgatgatgggtgtggtgtaccccatgctgttctcgtgatagtgagtgggttctcatgagatctgatggttttataagtgtttgaaagttccctcttcactcgctgtcttgcctgctgccatgtaaaatgtgcctacttcaccctctgccatgattgtaagtttcctgaggcctccccagccatgcagaactttgacacaattaaatgtcttttctttataaatta

SEQ ID NO: 18255 - DNA, 784 bp, Homo sapiens
agcgggagggcgaaagatggcggcggcagtactgggacagttgggtaaggatttcttagtggttaagcgacagaagggagtcgagatggaatctgagttgacggcttgtgttgatgttgcaggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaag

SEQ ID NO: 18256 - DNA, 3162 bp, Homo sapiens
gggcgaaagatggcggcggcagtactgggacagttgggtgcgttatggatacataacctgaggagccgggggaagctggccttggggcttctttcatttcacagtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaatgctttttatgatttctcattgaattattgaaacagtgtataactgctagttgtaaatgaatatttataaggctttgcccatttcttttgagcctctgggcatatttgtatgcatttgcgacttggaaggggaaatcagctttaaacatagtaacagactatatttcaaaaggcttttggagtaactttgaaagggaatgttaactttccaactagtgtcctgcaggtggctgttttgatactggacttgaatacagtgttatgaggtaagaaaattgcttttatttcacttaattttctcttgggaccatgggaagttagagtggctgcatgttgtttcattacagtattttagggtgttcagtggtaccgtttttcctttcactgttggcacaggccagtgagtcaaaaattatattttcctttactgttttagcagtaactcgaaactacaggagtttattagatatacgaatctaaaactccaaaaacctttaactttgaaaattttcttttggttaagcaaagcctgtttttatttcttcttccaacagtgctttatattgtttggatatcttgtttaggattgatttatttttcagggtaaattcaattactgagagaggaattgaaccaatctcagcattgcattctaaaatggggcagtaggtggcactcaaccttttattagcagaaaattgttagtttcaaattagagtgttcaacactgcttccctctcattcatacacgtcttcattaagaagaagtactctttgtctacagccctagtccaacttttgcatgcaaaagaagaatcgaggatgcttgcttgttaatgcagacttctgggccccaccccaatgattcaattcactaggtcttatggggggctggtttcagaaatctatgttttaaacaaacacttccaggtaattctgttgtaggggactacgctttgagaatacggctttaggagaatgaaaaaatgtagttttattgccatgttttaagatggcattaataatagttactgtttactgggaacttgttatttgcaagctctgtgctagtattttacataattcttcacaacatcctgaaaatgtagcttttgttttaccactttacaaaggaataaaccgaagcacacagaattcaaataactatcacaagtcacacagcatgtaaatattggggctatgattgaaaggtttctaaagtagctggttctgcataccttttgagtatacagctgggtttttgtgtctctccagttaacctaatgcatgggtaaaaagacatcaggggtcagtggaataaaccaaggtgtaggacagattcattctgggtcctaagctgttgtagcatggagtcagggaaataacactggaatattaaaaggtaaccttcattctagtctgtgcattctcattagccagaaagaagactggataggtctcttcccttgctggcctccatttcattcatttatgaaacaagagactcaatgttctctgtagaaaaccttttttagaatcacttgaagaatttgtttaaaaatgcaaattcctgggctctactctcagactaagtgaatcagaagctttggtgtgggagaccatggaacctgcagttttaataaatgccccagtgatttgcatgttggagaattatcacaccaggtcactgtgctctcatgtggtggggatgctccacgattgctcttggagttgtgacttccttgggtgtgactaaagccaggtggtgccatggacatcataaatataaattatgtaagtgaaggcactgcttcagtcaggctgtaaaagctattttgaaagtggtaaggaaaaagtaggattgtaatgaagaaaatttccttcccaggttaagccttcatttggaactgcttccagtacgttacaaaaagtaataatagctaacctgtgtcactgactgtatctggtactattttaagcactatatatacattatctcaatgaatctttcccattgtgacatccggctagttttcgtggctaagagtgtactttctaacatccatgaacattgtggtccccacctgaagtttcactttgcatgttcagtgatatggtttggctctgtgttcccacccaatcttatctcaaattgtaatccccatgtgtccagggagggacctgtaatccccacctagtgacggagggaggtgattgatgatgggtgtggtgtaccccatgctgttctcgtgatagtgagtgggttctcatgagatctgatggttttataagtgtttgaaagttccctcttcactcgctgtcttgcctgctgccatgtaaaatgtgcctacttcaccctctgccatgattgtaagtttcctgaggcctccccagccatgcagaactttgacacaattaaatgtcttttctttataaatta

SEQ ID NO: 18257 - DNA, 3176 bp, Homo sapiens
ggcgcttgaactcggcggcttccgtagcgggagggcgaaagatggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaatgctttttatgatttctcattgaattattgaaacagtgtataactgctagttgtaaatgaatatttataaggctttgcccatttcttttgagcctctgggcatatttgtatgcatttgcgacttggaaggggaaatcagctttaaacatagtaacagactatatttcaaaaggcttttggagtaactttgaaagggaatgttaactttccaactagtgtcctgcaggtggctgttttgatactggacttgaatacagtgttatgaggtaagaaaattgcttttatttcacttaattttctcttgggaccatgggaagttagagtggctgcatgttgtttcattacagtattttagggtgttcagtggtaccgtttttcctttcactgttggcacaggccagtgagtcaaaaattatattttcctttactgttttagcagtaactcgaaactacaggagtttattagatatacgaatctaaaactccaaaaacctttaactttgaaaattttcttttggttaagcaaagcctgtttttatttcttcttccaacagtgctttatattgtttggatatcttgtttaggattgatttatttttcagggtaaattcaattactgagagaggaattgaaccaatctcagcattgcattctaaaatggggcagtaggtggcactcaaccttttattagcagaaaattgttagtttcaaattagagtgttcaacactgcttccctctcattcatacacgtcttcattaagaagaagtactctttgtctacagccctagtccaacttttgcatgcaaaagaagaatcgaggatgcttgcttgttaatgcagacttctgggccccaccccaatgattcaattcactaggtcttatggggggctggtttcagaaatctatgttttaaacaaacacttccaggtaattctgttgtaggggactacgctttgagaatacggctttaggagaatgaaaaaatgtagttttattgccatgttttaagatggcattaataatagttactgtttactgggaacttgttatttgcaagctctgtgctagtattttacataattcttcacaacatcctgaaaatgtagcttttgttttaccactttacaaaggaataaaccgaagcacacagaattcaaataactatcacaagtcacacagcatgtaaatattggggctatgattgaaaggtttctaaagtagctggttctgcataccttttgagtatacagctgggtttttgtgtctctccagttaacctaatgcatgggtaaaaagacatcaggggtcagtggaataaaccaaggtgtaggacagattcattctgggtcctaagctgttgtagcatggagtcagggaaataacactggaatattaaaaggtaaccttcattctagtctgtgcattctcattagccagaaagaagactggataggtctcttcccttgctggcctccatttcattcatttatgaaacaagagactcaatgttctctgtagaaaaccttttttagaatcacttgaagaatttgtttaaaaatgcaaattcctgggctctactctcagactaagtgaatcagaagctttggtgtgggagaccatggaacctgcagttttaataaatgccccagtgatttgcatgttggagaattatcacaccaggtcactgtgctctcatgtggtggggatgctccacgattgctcttggagttgtgacttccttgggtgtgactaaagccaggtggtgccatggacatcataaatataaattatgtaagtgaaggcactgcttcagtcaggctgtaaaagctattttgaaagtggtaaggaaaaagtaggattgtaatgaagaaaatttccttcccaggttaagccttcatttggaactgcttccagtacgttacaaaaagtaataatagctaacctgtgtcactgactgtatctggtactattttaagcactatatatacattatctcaatgaatctttcccattgtgacatccggctagttttcgtggctaagagtgtactttctaacatccatgaacattgtggtccccacctgaagtttcactttgcatgttcagtgatatggtttggctctgtgttcccacccaatcttatctcaaattgtaatccccatgtgtccagggagggacctgtaatccccacctagtgacggagggaggtgattgatgatgggtgtggtgtaccccatgctgttctcgtgatagtgagtgggttctcatgagatctgatggttttataagtgtttgaaagttccctcttcactcgctgtcttgcctgctgccatgtaaaatgtgcctacttcaccctctgccatgattgtaagtttcctgaggcctccccagccatgcagaactttgacacaattaaatgtcttttctttataaatta

SEQ ID NO: 18258 - DNA, 643 bp, Homo sapiens
gggggcgctgtgccaggcggcggccgtgcggggcgggcgcgctgctccttccgcctcgcggaccccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagtcccgacacctaaataaaagtcttgctgcaggagaaagagccggaa

SEQ ID NO: 18259 - DNA, 736 bp, Homo sapiens
gggggcgctgtgccaggcggcggccgtgcggggcgggcgcgctgctccttccgcctcgcggaccccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaagagccggaa

SEQ ID NO: 18260 - DNA, 883 bp, Homo sapiens
atgtgctgaaaatccgaagtgccgcggaaagtggaggtgagggccgcccgccctagaggtgcccgtccgagaggcagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtc

SEQ ID NO: 18261 - DNA, 883 bp, Homo sapiens
agaaagtcgacgggcgtggcgggggaggggacgctgagggcccatgtgctgaaaatccgaagtgccgcggaaagtggagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgag

SEQ ID NO: 18262 - DNA, 514 bp, Homo sapiens
atgtgctgaaaatccgaagtgccgcggaaagtggaggtgagggccgcccgccctagaggtgcccgtccgagaggcaggtgcgggaagagcctatccttttccctggccatggctcagtcgcctccccagggtttatttgcaccggaagtttggagcggagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattgg

SEQ ID NO: 18263 - DNA, 448 bp, Homo sapiens
cttgtctgtaaaagggactttacgatgcatctggcaacctcaccttcctcactgggcaatgtgaagaccaaatgccggcaatgaaattcccagcattaggtttgtcatatagtagtcctctctaagcatttgttgaatactcacaggaacacttaggccagtcagcattaattgaaaataacagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaag

SEQ ID NO: 18264 - DNA, 990 bp, Homo sapiens
agatctgacattttgtaactagatcggctactagcattggaagggcccacgtttcatcccttcctctagaaagcctaccggcagtttttgaatctgccctgcccccactccagcagagaaggacagggagagcattggcggtagccctgtctggaaagggcggccctttgccttgaacaggaagccacaaccacctagaaaatggagccttcttctctagaaactacaattcccagcggcctccacgcagagcatgcgcgggaatgtgccaggcgggccagccgaaccagcttgcctttcgattcccgacatgcttcatggtgtgttccggtttccttgatttcctacccccgccaaacttcctgtttccagctttctagcggcggactacaactcccagcatgctgagagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggc

SEQ ID NO: 18265 - DNA, 716 bp, Homo sapiens
cggaagtagaaacttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggaca

SEQ ID NO: 18266 - DNA, 2435 bp, Homo sapiens
ttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgagttgctccgttgctgcccccctttttccttttctaggttgacctctccttgcccctaagcatggtaataacagttgcatgtattgagtgcttaccaaatggcaagcattgtgctgattcccatgcctacacgatctcatttcttccttaccacatccctgtaagtaaggtgaaatgccagagacctagacggggtggaaggagcaagtgactgctgggatttgcaccaggtctgcctaactcccagatcactatgatttgccctggtgttgcattggcctggtattcttggttctcctttctaaccctcagttcttggaggacaagatacctggtgatttaaaatattattttagtcttgggaaactaatttcaatttattagtttttcattattctaagacttcttcctttgtataaacttacttgcagatggttgaaagatagcttgaatttaatgaaatagaattcagtgtgccaggagttaggttcataccaggtggggatttcagtttcagcaagttggcatcatttttatagggtaggacagttctttgttacagagacataacgatactgtactctccacattattttaaatattagttgcctttgtaaacagtttcccctcccccacccctttttcgataattttagtaggtacaaaaaggttgatagtaacctgtatttatttcaaagatgctaatttgtatgtgaattgattatgtatgtagtagctttttaccttttagaacttaagacattagatgtgtggctatgtcaacaataataatcaaagctaacacattttgagctagacagtattctaggccctttatgattgttgagcattaatcctcaaaatgaccctgtaaaatagttaatattatccccatttgacagacgaaaaaatagaggcacagtgaagtaacttgcctaagaccacacaggagtaagtagcagtgctggtatttgaaccaggcatcctggctccagagcccattcttttaatcagagagacagagaataatgctggactacctgggtaaaatttgccacacacccagcctgaagttctaaaagaaaaagctaaaaaatatggttaaaaactgtatatacaacacagtttaatctctctgcttcatatttcacatctgaaaagtggcgttggaaataatacctctttcactaggtgagaattaaatgacttaatgtgtattaaagggcttacatgggtattagctaatgcagtagtatgattgttttattagcatatgcattatccatatagctttggtttatattttccatagagcctaaactttatagatcactatctaaatgaaaatttacatcaaactagtgttttaatatgacagttctagtgttgtttaagtctaagtgaagatttagggcatcttcctgggttttgggatttgtgcagtgtggcttctgaccagctgcatagacatggctccaggtaacagtccctgggactgagcagtggcccatgttggctgttggagctttcttttccctcatttgttatgagtcaataaagaagcagaaggtttggacgtgctagccagtgggaaagggaacctgagatggagctctctgatcaccctttcagccccagggcccggctctgtgtgagaagtctgtcccaaaattctgggacggaccacctcgctgaccagctgaccagctgaccaggtctgtgtgttgcaggtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggac

SEQ ID NO: 18267 - DNA, 732 bp, Homo sapiens
ggtggagccgtgagtgagggcgtttgaagagcacttgtctttctcctgcctcagcagcacggacgggttccttggcggttggggatttggttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacacacctggatg

SEQ ID NO: 18268 - DNA, 869 bp, Homo sapiens
aaaattagctgggcgtggtggcgtacacctgtaatcccagctacttgggaggctgaggcaggagaatcgcttgaatccgggacgcggaggttgcagggagccaggactatgccattgcactccagcttgggcaacaagagtgaagctccgtctttaaaaaaaaaaaagaaagaaagtcgtgggtgagcctgaaaccgaagcctttctggatgtactgggctccccaagtctgttctggcccctccgtggtgcatgaggttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatg

SEQ ID NO: 18269 - DNA, 1086 bp, Homo sapiens
cggttccggtgggctctgaaccctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggc

SEQ ID NO: 18270 - DNA, 865 bp, Homo sapiens
aaccctgaaaggtgggcgcgggcaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactg

SEQ ID NO: 18271 - DNA, 1053 bp, Homo sapiens
tcccgccaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaaggcaagcggggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaa

SEQ ID NO: 18272 - DNA, 1596 bp, Homo sapiens
gtcagcggtgggaggagggccaggcgcggcagatcggcttccggttccggtgggctctgaaccctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaaggcaagcggggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgtatctttgctttgaggactggtgttctctttggggatcctgatcctgtcacccctgcccttgctgcccctgagacctcggatgagccgtgggcattgactctggctgtgcccgtcccccggtgagctgcagagagcgaggttcaattctgtgttttgtgtttttttttcttttctttttttgagacggagtcttgctcagtcacccaggctggagtgcagtggcacgatctggactcactacaacctccacctccagagttcaagtgattgtcctgtctcagcctcctgagtagctgggattacaggcaccccgctatcatgtatggctaattgtattttagtagagaaggggtttcaccatgttggccaggctgggcttgaactcctgacctcaggtgacccacctgcctcaacctgccaaagtgttgggattacaggcgtgagccacctcccctggc

SEQ ID NO: 18273 - DNA, 310 bp, Homo sapiens
tccggcaaaggagcacgctgagtgaagaaccgcagttctggcaaacaggactgataaagtaggggtgaggtggggtgactcaggccgggggagcaaccagaggccgtggggagtcggggtaaagttaggatggggaggaggcctgtgtgatgagcagagcaggtgggagaggcgagcagagcaggtgggggaggcgagcagagcttcgaggcctgggccgcccagaggctcctctcaggctgggccccgacgtttgcggcagtgttccttgtgcccgtggggccgggagcgagtaaagtctgggccaggc

SEQ ID NO: 18274 - DNA, 800 bp, Homo sapiens
acaggggccggagtgagaaccgggggccggggtagggggtagcgggtgagagccgggggccggggtagcgggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagca

SEQ ID NO: 18275 - DNA, 722 bp, Homo sapiens
aaaggtgggcgcgggcaggtggggtgtgggggggcgccggggcagaaggggaggggcaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttgga

SEQ ID NO: 18276 - DNA, 619 bp, Homo sapiens
cgggtgagagccgggggccggggtagcgggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttg

SEQ ID NO: 18277 - DNA, 1694 bp, Homo sapiens
agagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaa

SEQ ID NO: 18278 - DNA, 1457 bp, Homo sapiens
tttctttccgtcgcagagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagggtaacgactaacagtttaaatgtgagccttatccgaaggaatgtggggagtgaggaaaaggttggagacctgaaaaaaagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgtt

SEQ ID NO: 18279 - DNA, 1377 bp, Homo sapiens
tttctttccgtcgcagagagcatcggccggcgaccgttccggcggccattgcgaaaacttccccacggctactgcgtccacgtggcggtggcgtggggactccctgaaagcagagcggcagggcgcccggaagtcaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcc

SEQ ID NO: 18280 - DNA, 2605 bp, Homo sapiens
ctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagactgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccagcagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcagcctcgacctcccaggctcaagtgatcctcccacctcagcctccagagtagctaggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctattttagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgcca

SEQ ID NO: 18281 - DNA, 1497 bp, Homo sapiens
gcctctaaagagagcaatcactacacttatggctgggattttgcgcttagtagttcaatggcccccaggcagactacagactgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccagcagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctattttagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataa

SEQ ID NO: 18282 - DNA, 1035 bp, Homo sapiens
tgtggccgatttcctttcatttccccgcccctcacctttcctttactctctatgattggaggagagtcagagctgctccaagagcatgcggggtgttgtagttctaagaagcgaggcttgcccgattctgtgcctgtgcgcatgctgaaagcaggggcgggaccggggcggtcttccagcagggaaaatggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaagaacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacgggagagacaccgtctgaacaagatcagggcaagaggatcattgaacgagacagaaagcgaccatcctggttcacccagaattgacaccaaagatgttaaaagggtaacttcacagtaaatcatttctcctgaaatagaggaagattctttatgttgttgtgcttgtttttaaatcatcagtatagtttaacacattctttctaagcagttttgtgtgggataatttgaagaatatattatgagtaaactccgaaaattttgtttatccaaaggctcaatggattatgtttctattatatacaaggttttaagtaaacataaaatttccagaacaaaaataaaaaatttaaaattcatagcaaaaa

SEQ ID NO: 18283 - DNA, 2734 bp, Homo sapiens
cagcagggaaaatggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaaggtaatgcattgatttttgtgggtgtgcttttcctcaagtcctccattgaataagctcatggtagattcctatagcctaggaataaattattatcagattatatgtgtctactttcctctggcctaaatgaaatacagtattctcattatatacataatgagaaggctagagcctgctgtcctctagcctgagtattagaaacacagtcaaggaaggagtgagtttggagactgggcaaggaacgaggctgtgaggtgcctacatgacttctgaattgtgagctgtgtcagtcttgagctgtgtgagttttgaactacagatgagtaaacatcctaactatggcagagcctagaattaaagctagaagcagtaggtatactgaatcttgggttttacaagcccttacatatttgttttatttttttatcatttccaacaaaataccatgaaggaaaaccctaagataagtaatataatagctaacaacaattaagtgtctatgatgtatctcagtgccttatgtttattatatctcatcatgtcttatagccctccaaagcaaataagatattcttcattattaggatgaaaaaactgaggcaaaaagaatttgcctgtggtcacacagctatgaagcagtagattttcgagctctgatttttgacctcatgttcttttaaagattttctttgtgttctcctatcctcagacaatttcagattctcctcgctgacaacatggatgtactgtcttcattgatctagtaaagaaaaattacagtgtgtattacctctgatctgttcatgtatggttttaacagttaggatttcagttactgtttacttcatggcgttccacaacagcagcaccatacagatgaaactcgagaacagaaagctgactttcataagcatccacattctgttaagcaaaaccttagaacttaagccagaaagtattattgagtgatggttggggctgaacttaaatgtagaactgaaaaacactttattacttaagacttacagtaattcataaatttgctcaagaggacgtaagattttaggaatgagatcttgcactgatctattatgtgacttccctgatcgcatttattctgaaggaatagttcttatcctgtgcatttattttcttccttgaattattttctgttacatacggtatatagtgtgttatgttgggtactttgatcacgaaaggaagaccagctgactgtgggtgtcttcataccttcagttgtgcatgcaatccagtttccagtagtggagcaaaatgagaatatggttaggcaagtaatatacaagcctctttcttcctttcagaaaaggaaattcttttgttatctgcctcacaaatgttagtatattaatcttatcaagtgtttaaagcttctttaatgatcctgtttagtatttttctttgtattttctttcaaacctacatctagaataagttgataaatcttttagaggttataatgtttctattttatatttaaagttggagatatatatatatctatatctatctctatatatatatatatacacacacatatatatatcattaaaataccctaagaatgtaacatagaaaataattttacattaaggaataatcagtgttcatttttaaaaagaaaaattataccatatacgaaacctgtattctgtacaggaatttgaattacactgtgataaaaagaggaagccaaggaagtcaacttgtaatgttcttatcttgttttccctaagatagattgaaagacaaagggaattcacttttccttggtgtcttatttaagatgctgattgtttgggtcacttcattatgttgacaaattccttatttgatatttagtatttggagttaggggaaatgagtatttcttttttcttttttacataactacaactgctgtgtttaagtaaagataccagattcaggttggctgaattctagttctagtttttctctaattcaaactcagtgttgcttgtcttcagtcttcctgttaaagtgaggtggaactagatggtgtatgatgacctcatgtagcctgaacatcctaagaaagttaaaataacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacgggagagacaccgtctgaacaagatcagggcaagaggatcattgaacgagacagaaagcgaccatcctggttcacccagaattgacaccaaagatgttaaaagggtaacttcacagtaaatcatttctcctgaaat

SEQ ID NO: 18284 - DNA, 968 bp, Homo sapiens
ccggctacctgttggtgtgtatgcagagcatccctgtgccccgcggatatagactggcgcgcctctgttgcgcaggcgcagaactacaacttcagggttttccccaacggcctcttttttgcacgttaggagaaactacatttcccataatcctttgttccagggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaagaattatcaataattttgaaatattattaaacgtgtaataaatgttcaaagttccacttgc

SEQ ID NO: 18285 - DNA, 959 bp, Homo sapiens
aaacccaaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactgacggcaaagccaaccacttagaagccttccacatctttgtcacctgcctggctcctgctctctgatgtacctctgggtagtgagatggaaatggtgcctgcagaagttggggagaaggatacttttgcacagcctccatgatgtctttattgcaaatatggatgacaagggtctctgttacaggggcctcagagcaccttcgtttctcctctagaccagggacaggtgtagagataaggactggcaaccagagcctcagcatccaaagatggactgaagtgggatggctgacaggcacataacttacgggaaagggaatttcatacatacgatttttgttttgtgggtaggagggcttatcatcaacactgattttataatctgacaataaatgtctttcattaaagagttta

SEQ ID NO: 18286 - DNA, 3727 bp, Homo sapiens
aaacccaaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactggtacgttgatgatccttatcagaagtatcatgatcgaacaaacctgaaagtatagatcagaagtttcacttgtttctcagttattggatatgtatctttgtgtacatatctttgcaaaaatggataagtacaaaacttgatgtaaattgtaccaatgaatacgtaaacatacagtgacaacattaaacttagaaaagttttaaaacttaatggatcagactttgccagatttggttagggaaacagaaatttagaatggtgcattatttttaacaaatggtattggcttaactagttgtttcagttatgctcttttagttgcaaggaatctcaagtgggacaaacataaaaagactcaaaagctacaagttagctcaagcaatgtgacattatttcaaggatatgtgccagggaattcaggaaccacctcaccaaccccatctcccactcagaaatcacctcccagcctcaggaagagtagaaattgggtggtgctcctcagcaggggaaggtggatgtttaggcttgggctctgcatgcatgtgacttgcttctttttgcattgttaactccattctctctattcaccaacttctctacacagcttttgcatacttacagtttctgttcctttgtaataactttaacttgcacctttgaggttcttttctacatgatgaccttcagctcctgctgctagtctccaattgccaagggaatttaactgggccagactacctttttatactaggtctggttgggtcattgtctagagtagggattggctgtccttaagtcaggagcccgctttgtattagcaggtttgcatgcagcaaaaaaacagttatgtgagcagtttcacttggaggttcacatggggtggcagcacacttaacatctaacacaccaggttcattgtgttcataacacttgtcatttactgtaacaacattttttcataggagagtaaatagcccttcagcatgctcattcatgaaacagaagaggctgtacaagtgaagacaagggctttttatgcaagttttgaaagataggtatttattttttctagagacaggagttttgctctgttgcccaggctggagtgcagtggtgcaatcatagctcattgaagcctcgcactcctgggctcaagtggtcctcctgcctcagcttactgagtaaggatatgtatttcttaaaagttagtttatccacttcagatttcatgttttcatttgtaaggataaacttttcccacaaattttcaacaatcattgtagaaactaagggggagaaagtaatctcagttgttttagaaacgaaaaagttaagcattgtttacttgaagtgggcagggaagcagcactgagtaaagttcaattgagtggttacagtctagggcagtggttcccaactctccgatcagaatcatctgggaagcattttcaaacagcaaagtactttgaaaaccattattaaatagaattatgcatgaattactgtttcagatcctttaatgtggtagttggtaataataagatgaaattcctctgttgttagtaaaattatgaaattgaagttctgcagcatgtcaggccaggattattagggagattcctcgaaactagtgtgtgtttattaaaaggagaaaggataacaatagaatgttctaaaaccagaagtccaagtgcgtgtctacttatgggaccaataaataaagaacagacatttgatttgaggtgaggtaaaagcctgaaacatggaatggcattctgttttgatggattttcatttcttcgcacttctgagacggcaaagccaaccacttagaagccttccacatctttgtcacctgcctggctcctgctctctgatgtacctctgggtagtgagatggaaatggtgcctgcagaagttggggagaaggatacttttgcacagcctccatgatgtctttattgcaaatatggatgacaagggtctctgttacaggggcctcagagcaccttcgtttctcctctagaccagggacaggtgtagagataaggactggcaaccagagcctcagcatccaaagatggactgaagtgggatggctgacaggcacataacttacgggaaagggaatttcatacatacgatttttgttttgtgggtaggagggcttatcatcaacactgattttataatctgacaataaatgtctttcattaaagagtttacctaaatgatgttcgattatatgtataatttataaaatatttatgtatagtttgtttattcaggtatatgtataatttattgaacacctactatgtcccagcatatctacaaaactgggtacatacatactgtctaactgctaatccacatttccagtcttacaaaggacataatgattagttaagccctaatttagatttgaggaaactgaagctgagagagggttaagtaaattacccaaagtacagctaataagacccagaatctcagtctcactccttgggatcctgtgtatttccctgagtcttctaacatatgaaaattcatatctaaatcaacaagtgactgtaatctggtactataaatactaaataaacacttcttcataacactgtaccaattcagcttttaaattttattactttgctttcctgtcctttgccaactcttaacctagttaatcctagttctgttgacattggaccaggctcagtaaataaacgaatggatttccagcctttttttcccatctgttcctgcttttagtcctctgaatctgcttcttttcttactgctgctttattttacagtgattttgtcaaacatagaatacaggactaaaaatgcaaagaaattgggtctgtgtttaattttgatgtttcaaattttgagcttccaagtctttgtggccacccaatgaagtttgagtctgcctgttcagatgtgaaaggtaagggctgcagcaggtttaagggtggcccttcaccaccctgttgtcacctgcacaggcactcccccatttgcagatgaagaaatgttcagagaagaaaaatgatggaccaaacgtctgtttgcacaattgaaactctaccagtggactattctattttcacagctacctagtttctgccgatgatttttttaaatgtgaaataaacagtgatactttcaggtt

SEQ ID NO: 18287 - DNA, 590 bp, Homo sapiens
cagtgcgcagacgcaggggtcggcgccggattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccgaa

SEQ ID NO: 18288 - DNA, 665 bp, Homo sapiens
gccacgtgacccccccccccgccgccatcttccttcctggcagcagcgtccgcgtgccagtgcgcagacgcaggggtcggcgccgggtgagagcgtgcggccggattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccgaa

SEQ ID NO: 18289 - DNA, 595 bp, Homo sapiens
atgcgcacggcttctggcggcgccaaacacccgattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccgaat

SEQ ID NO: 18290 - DNA, 686 bp, Homo sapiens
gccacgtgacccccccccccgccgccatcttccttcctggcagcagcgtccgcgtgccagtgcgcagacgcaggggtcggcgccgggtgagagcgtgcggccgggtaagggagccgtcttctcagattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccgaa

SEQ ID NO: 18291 - DNA, 1484 bp, Homo sapiens
acatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactgtaacgagggtgtcaagaatttggcctgggtggactcagaccagctcctctatcagcatttttggtgtctcccagtgatcaaaaagagagtggttgtgacaggtccttgcttctccaaatcccaaatgtctaccagcttcgtcctcactccctcattcaacgcaggagaggaagtgatgcagcggaacttgagggcctcagccagcctcccgcccagtacaggctccccagccagtgagctggtgaaggagcaggagcacgctgcagggagagtgctgcgccgggtcatgctggatagcgaaaccccacgagaggaacttccagcagcagacttttggaaatga

SEQ ID NO: 18292 - DNA, 1122 bp, Homo sapiens
gaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgaggtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactgtaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttg

SEQ ID NO: 18293 - DNA, 1478 bp, Homo sapiens
ctcattcgttcccagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactgtaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 18294 - DNA, 868 bp, Homo sapiens
agtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactgtaacgagggtgtcaagaatttggcctgggtggactcagaccagctcctctatcagcatttttggtgtctcccagtgatcaaaaagagagtggttgtgacaggtccttgcttctccaaatcccaaatgtctaccagcttcgtcctcactccctcattcaacgcaggagaggaagtgatgcagcggaacttgagggcctcagccagcctcccgcccagtacaggctccccagccagtgagctggtgaaggagcaggagcacgctgcagggagagtgctgcgccgggtcatgctggatagcgaaaccccacgagaggaacttccagcagcagacttttggaaatgaaatggtgacattcccattgtgaacgtatttctcactgtctcatatatttaaattcctggttgttccattcaaaa

SEQ ID NO: 18295 - DNA, 1888 bp, Homo sapiens
cgggttttcaccgtgttggccaggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgagcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccgggc

SEQ ID NO: 18296 - DNA, 1887 bp, Homo sapiens
gaaaatgtttcctgttatttgctggacaagtcccaaagaacaggcagatgttcttattaaaagatcagcctataagattggtcaggaccaggcgcctctggccacgtgcctctcccctccagcacctgcggtctgcggtggcacctggcagctggaccacagccaggagaagggtactattagccctgcttcaaacatgcagaaactgaggcccggggagattaaataacctgcctgaaatgacagtgagtagctgcgcctggatttgagttctgctctggccaatccccaagctccacgctgtcagccaccccgctctcctacctcccagaggagcaggctacactcctgttccttttagagagagaaatattgcggccgggcgcggtggctcacgtctgtaatcccagcattttggcaggccaagggttttgccatgttcgtagggctggtctcaaactaattacctcagatgatccgcccacctcggcctcccaaagtgctgggattacagccgtcctgggccgccggacacccccgctggggccgatgcccaacagtgacatcgacttgagcaacctggagcggctggagaagtaccggagcttcgaccgctaccggcgccgagcagagcaggaggcgcaggccccgcactggtggcggacctaccgagagtatttcggggagaagacagagttccagctcctaaaatatttgctcctaaaatcttgaccacctgactttccggattgggatgccgttctgtgcgcctcaaatactctgtagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccgg

SEQ ID NO: 18297 - DNA, 1199 bp, Homo sapiens
agggcggagaaggacttgcgcgcgacggttctcaccgctgctatggaggcgctggccatgggttcccgggcgctgcggctctggctggtcgcacccggtggcgggatcaaatggagatttatagcaacatcgtcagcttctcagctgtcaccgacagaattgacagaaatgcggaatgatctctttaataaagagaaagccaggcagttatcattaactccccgaactgagaagatagaagttaagcatgttgggaaaactgaccccggtactgtcttcgtgatgaataaaaacatttcaactccctacagttgtgccatgcatttaagcgagtggtattgcaggaagtccattctggctctggtggatggacagccttgggacatgtataagcctttaacaaagtcctgtgaaattaaatttcttactttcaaagattgtgatccaggagaagtgaataaggcatattggcgttcctgtgctatgatgatgggctgtgtgatagagagggcattcaaagatgaatatatggtcaatttggtcagagctccagaagttcctgtaatttctggtgccttctgttatgacgtagttttggatagcaaacttgatgagtggatgccaacaaaagagaacttacgttccttcacaaaagatgctcatgctttaatttataaagatcttccatttgaaactctggaagttgaagcaaaagtggcattggaaatatttcaacacagcaagtacaaagtagatttcatagaagagaaggcatctcagaaccctgagagaatagtcaagctacacagaataggtgacttcattgatgtgagtgagggccctcttattccaagaacaagtatttgtttccagtatgaagtatcagcagttcacaatcttcaacccacccagccaagtctcatacgaagattccagggcgtgtctttacctgttcacttaagagcacattttacaatatgggataagctattggaaagatctcggaaaatgactccatttcccattctccttctatttactacgcagtcattcttcactacctcgcctgagtcgtacctcctccatggaacagtctcagagtaactgaagatcaaagtaaagcaacagaggaatgtacatctacctaataactttctaaaatttaaatatgtataataaaataaatgttttaaatataa

SEQ ID NO: 18298 - DNA, 1110 bp, Homo sapiens
agggcggagaaggacttgcgcgcgacggttctcaccgctgctatggaggcgctggccatgggttcccgggcgctgcggctctggctggtcgcacccggtggcgggatcaaatggagatttatagcaacatcgtcagcttctcagctgtcaccgacagaattgacagaaatgcggaatgatctctttaataaagagaaagccaggcagttatcattaactccccgaactgagaagatagaagttaagcatgttgggaaaactgaccccggtactgtcttcgtgatgaataaaaacatttcaactccctacagttgtgccatgcatttaagcgagtggtattgcaggaagtccattctggctctggtggatggacagccttgggacatgtataagcctttaacaaagtcctgtgaaattaaatttcttactttcaaagattgtgatccaggagaagtgaataaggcatattggcgttcctgtgctatgatgatgggctgtgtgatagagagggcattcaaagatgaatatatggtcaatttggtcagagctccagaagttcctgtaatttctggtgccttctgttatgacgtagttttggatagcaaacttgatgagtggatgccaacaaaagagaacttacgttccttcacaaaagatgctcatgctttaatttataaagatcttccatttgaaactctggaagttgaagcaaaagtggcattggaaatatttcaacacagcaagtacaaagtagatttcatagaagagaaggcatctcagaaccctgagagaatagtcaagctacacagaataggtgacttcattgatgtgagtgagggccctcttattccaagaacaagtatttgtttccagtatgaagtatcagcagttcacaatcttcaacccacccagccaagtctcatacgaagattccagggcgtgtctttacctgttcacttaagagcacattttacaatatgggataagctattggaaagatctcggaaaatggtaactgaagatcaaagtaaagcaacagaggaatgtacatctacctaataactttctaaaatttaaatatgtataataaaataaatgttttaaatataa

SEQ ID NO: 18299 - DNA, 1456 bp, Homo sapiens
cccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggaaagcccagacgggcttctgcatccattccctctttttgtttttaaaataaattgtatttttgaatc

SEQ ID NO: 18300 - DNA, 1320 bp, Homo sapiens
cccaaagtaggctaggcctacggaagctgggtcttcttgctgtgagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggaaagcccagacgggcttctgcatccattccctctttttgtttttaaaataaattgtatttttgaatc

SEQ ID NO: 18301 - DNA, 2404 bp, Homo sapiens
cccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggtgagcaaagagcccaggcccctagagtgcgcatgtgcaggctccgctgttagaatcacagcggttcaaatccggcatctggtcgctgagtggcctcaggcagtgaccacgctcccggacccaaccttcagcttgcccaaagcaataatctttcctaaagaagtgcttggctggggatggtggctcacgcttgtaatcccagtactttgggaggccaaggcagtctgggcaatatagtgaggctcccatctgtactaaaaataaaaaagttaggcgtggcgatgtgcacctgtagtcccagctactcgggggctgagccaggcggatagcttgagctcagggggccaaggctgcagtgagtcatgatcgcaccactgcacccaaacctggggagagagctagactcttgtctcaaaaaaaaaaaaaaaaaaaaaaaaaaagctccaaagtcacctctgtcaaagccacagtctgttccttccacagccacaagatggcgacatgagcctaagtcaagtcctgtccctcaacccacgcccctcgctggcttccccacctctctcaggatgaaagcccaagtcatcagggtggcacgtcaggccctgcacgatgtgccccgtcacctccctgccctcccgtcatttgccctgggtctcccccaccagaatgggagccaggagtcccagccaggcacaggaccgagcctggctctcggtcagcaggtgatgagctgggagcagctccttggccagaggcttacaggcaacaagcggccaggcagggtctggccccgggctgctgggctcacaaagtcacactagaccacagtgacgatctctgtaagcacaaagggactccgatgtgggtggggtgaggagagaggcagccccggcctgaccggccccccgccccgcccccaccccgcccccaggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggaaagcccagacgggcttctgcatccattccctctttttgtttttaaaataaattgtatttttgaatcaaggaggataaagataa

SEQ ID NO: 18302 - DNA, 1423 bp, Homo sapiens
gtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggtgagcaaagagcccaggcccctagagtgcgcatgtgcaggctccgctgttagaatcacagcggttcaaatccggcatctggtcgctgagtggcctcaggcagtgaccacgctcccggacccaaccttcagcttgcccaaagcaataatctttcctaaagaagtgcttggctggggatggtggctcacgcttgtaatcccagtactttgggaggccaaggcagtctgggcaatatagtgaggctcccatctgtactaaaaataaaaaagttaggcgtggcgatgtgcacctgtagtcccagctactcgggggctgagccaggcggatagcttgagctcagggggccaaggctgcagtgagtcatgatcgcaccactgcacccaaacctggggagagagctagactcttgtctcaaaaaaaaaaaaaaaaaaaaaaaaaaa

SEQ ID NO: 18303 - DNA, 1262 bp, Homo sapiens
gggcgacttccgcgtggggtgagaggtcgcctgcgagggtgaccgggcaggagggctcagtgcgcaagccggacgtgctgggtccaagattattgattaatttgggcaccgcgagggctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcgagccccgccccgcgagccccgccccgcgagccccgccccgcgagccccgcaccgccggccccgcaccgccagccccgcgagccccgccccgccccgcgcgctcctcgcattggccgagtccccgcggccacaccccctaccagattggggccgctattggacgcggcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagcta

SEQ ID NO: 18304 - DNA, 2042 bp, Homo sapiens
cgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaattcgggcgtacatgtgcagatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatattta

SEQ ID NO: 18305 - DNA, 777 bp, Homo sapiens
agcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagttgacttatatccaaaattctacaaattcttagctatgttataaatgtagaaagaagtgaaaaatcaaaatatgattatgaagattttcttctcttccgagtacaaagctctgctaaataaggatttacccaagatgcccacatccacatacttatgt

SEQ ID NO: 18306 - DNA, 3138 bp, Homo sapiens
gcgcagcgctgtttcgtgggaccaggattgaaacaagatggcgggttcgtggtgagaagccgtcaaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaccagctttgtcgatggtgtattcttgaaaaatgtttggttttctttcaggttgacttatatccaaaattctacaaattcttagctatgttataaatgtagaaagaagtgaaaaatcaaaatatgattatgaagattttcttctcttccgagtacaaagctctgctaaataaggatttacccaagatgcccacatccacatacttatgtgtcagtgctttggagaattaactttgactttattctactggaagtatagattaacactgtgctttctgggattttgcttttcatgggttgctgatttttaattttgctaaataagcacatagtccgtgatcaccagcatcacctgccctctgttcctcccccgtcccccagggataagaacctgttatccaccatcagtaacattttatgaaagatctacttatttgtctgttttgcagacattttaaaattcgtaaagtgggatgcttctttaatttaaatacatttagcttcatgaaaaactcactacacagttcttgttcaagcattattgggaaaccaccagagggcactctcacccagggcttaatttgaacatctcgcccaaaagtgacttttaaaagcacttaattagcagagaatttggatgttcattagttgagaatgactagtagaataaatggtaatagtgaaattaagtgctggaatattctgagtagaccaatagcaaaaactgatttttttttttttttaaagaaaaggtcttgctgtgtcgcccaggatggagtgcagtggcacaatcacattgcactgcaacctcaatatcctgggctcaagcaatcctcccaccgcagcctcccgaattgctgagactacacatgtgtgctaccatgcctggctaattgttttaattttttttatagagacggggtttcgccatgttgcccaggctggtcttgaactcctgggctcaaagcgatccacccaccttggcctccaaaagtatgggattacaggtgtgagccactgtgcccagccttattttttttttttaagataatattgttaacattttgtatttctctgcataaatatatttcaaaaataaaaatagagctcataat

SEQ ID NO: 18307 - DNA, 920 bp, Homo sapiens
tgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtagg

SEQ ID NO: 18308 - DNA, 747 bp, Homo sapiens
cccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttgagcactta

SEQ ID NO: 18309 - DNA, 2134 bp, Homo sapiens
agtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggacactggcctgagactgtctgcagttgcaccgcagatcctcctgcccggctggcccgacccaccagacctccccacagtggatcctatctcatcctcattgacctctgctccagcccctatgctgtccgcagtttcttgcctcccgattgtccctgcactgaccactgtgtgctcagcgtgaaggctgcatagaagtgtgtacggcttgaggtttcagcatccaggctgcagaccccacgcagtgtctcatacagtggaatgtggcagatgagacgggctttcaggaaggaagtccacttcttctgcaggatcttcttccctcccaggtctccctggggaggtagaggcacgggataaggggccagggtcagaggtccagcctctatacccgtgccccaacgtcagcccaatccaccttgcagacacgagccacacgggccacacggtgactgctgcggctctgagtgaagctgccagagccctcctcagtggcacgctccgtgaagaagtagtacaccttgtcatcatcacccactgcactggccttgctctcccgcacgaggacggagaacacaaactccgcatctgtgggtcaggcagtttgagaggcttttgagacaggctggggattcctttccctcactctgaggctgacccctcacttgacaacacacaggaatggaatggacaggctcacctggggatttgggggtggggtggtcagctggccaagggagtaaaaatgaagaaatagtcccctaccccccatcatcctgtgcctcatcctcctaaccattgagccaatgcattggtgtctcctcagttctcagggagtgtgggtggcggctccggcggatgtcaggaatgctccggaattcatacctagtggctgtgtagaggcctccatctggcgtggggatattccaggcatgagagacatgtcatattcaacagggcacatgacatatacatggtggcaggtcctagagatgagatccacatcctaaaaataccatgtctgtgatagggaagaaggcctgctcaccaatgatgaggcctgtgaagccacgggctgggtcataaggacacttctccttcccctcctcgaagctggttggcaaggtgaaggcctcagcatcctagggaacaaggaaccagcagtaagtggttccgaagacaggcagggacagtggctcaaagtcagatcagtctggggtcagggatcagcgatcagggataggggcaggttgtatggcagatgcacctgacagcaataacttaagcatcccctgagaatgaccttatggcctcaaaacaatgtatgtttggagttccaaatctgcaagtggccaacctagagattcactccttatctatgaagaacatctgagcccctagcccatcctgtggaacacatgctgtccaggggatcaaggccctttgttttgggttaaatgaagtttgccaggtggaggtgattagggggaggatgctaagtgaaaatgctataaaaactgcatggtttttacaaaggggaatggttctccagtgcagcccgccgccactggagtgccctgtatggaagtccccttaataaaccatccgtctccttc

SEQ ID NO: 18310 - DNA, 1010 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacagggcccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtca

SEQ ID NO: 18311 - DNA, 894 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggatgcggctgagttcctcggcgaaggagcagggccctgctggtactccattgttgctctgcctcagaagcacatagctattgccattcatcctccgcagccggctgggcagtgccaccaagccattggacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttgagcactt

SEQ ID NO: 18312 - DNA, 798 bp, Homo sapiens
ctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccagtgcctgcttctgggggcagtgaccttgtgaaccactcatttttatgcaagtggcatccctaaaacctgagatgaggaagacttcaagggttttacagggcccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaag

SEQ ID NO: 18313 - DNA, 866 bp, Homo sapiens
ctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccgtgcctgcttctgggggcagtgaccttgtgaaccactcatttttatgcaagtggcatccctaaaacctgagatgaggaagacttcaagggttttacagggcccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcaca

SEQ ID NO: 18314 - DNA, 824 bp, Homo sapiens
ccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggacactggcctgagactgtctgcagttgcaccgcagatcctcctgcccggctggcccgacccaacacgagccacacgggccacacggtgactgctgcggctctgagtgaagctgccagagccctcctcagtggcacgctccgtgaagaagtagtacaccttgtcatcatcacccactgcactggccttgctctcccgcacgaggacggagaacacaaactccgcatctgtgggtcaggcagtttgagaggcttttgagacaggctggggattcctttccctcactctgaggctgacccctcacttgacaacacacaggaatggaatggacaggctcacctggggat

SEQ ID NO: 18315 - DNA, 884 bp, Homo sapiens
agtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggatgcggctgagttcctcggcgaaggagcagggccctgctggtactccattgttgctctgcctcagaagcacatagctattgccattcatcctccgcagccggctgggcagtgccaccaagccattggacactggcctgagactgtctgcagttgcaccgcagatcctcctgcccggctggcccgacccaccagacctccccacagtggatcctatctcatcctcattgacctctgctccagcccctatgctgtccgcagtttcttgcctcccgattgtccctgcactgaccactgtgtgctcagcgtgaaggctgcatagaagtgtgtacggcttgaggtttcagcatccaggctgcagacccc

SEQ ID NO: 18316 - DNA, 727 bp, Homo sapiens
gcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggatgcggctgagttcctcggcgaaggagcagggccctgctggacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttgagcactta

SEQ ID NO: 18317 - DNA, 1748 bp, Homo sapiens
ggggaagtgtgttacggggacactggcccgactactttcgttccgtcttccatcgttttctctcgtgcaatggcgtccgggctggtaagattgctgcagcagggacatcgctgcctcctggctccagtcgcccccaagctggtccctccggttcggggagtgaagaagggattccgcgccgccttccgcttccagaaggagttagagcggcagcgccttctgcggtgcccgccgccgcccgtgcgccgttcagagaagccgaactgggattaccatgcagaaatacaagcttttggacatcggttacaggaaaacttttccttagatcttctcaaaactgcatttgttaatagctgctatattaaaagtgaggaggccaaacgccaacaacttgggatagagaaagaagctgttcttctgaatcttaaaagtaatcaagaactatccgaacaagggacatctttttcacagacttgccttacacagtttcttgaagacgagtacccagacatgcccactgaaggcataaaaaatcttgttgactttctcactggtgaggaagtcgtgtgtcacgtggctagaaacttggctgtggagcagttaacactgagtgaagaattcccagtgcccccagctgtgttacagcagactttctttgcagttattggagccctgttacagagcagtggacctgagaggactgcacttttcatcagggacttcttaattactcaaatgactggaaaagagctctttgagatgtggaagataataaatcccatggggctattggtagaagaactgaagaaaaggaatgtttcagctcctgaatcaagacttactaggcagtctggtggcaccacagctttgcctttgtattttgttggcttatactgtgataaaaagttgattgcagaaggacctggggaaacagtattggttgcagaagaagaggctgctcgagtggcccttagaaaactttatggattcacagaaaatagacggccgtggaactattccaagcccaaagaaaccttgagagcagaaaagagcatcactgccagctagccgccatggatgcagcagcctgaaacttgagagcgaaagtgagataaatgtcaaaggtgtttcaagccagacattttcacaattgtgaagaaatagatgttttgtttctgttttttactgtgttcccaaaattaaataagtgttaaccaagtcacagtgtttttggttttgtttttctgaaatcttggtttgatcaaatctttttttttttctcttgagatggagtcttactctgtcgcccaggctggactgcagtggtgcgatctcggctcactgcaacctccacctcacaggttcaagcgattctcgtggctcagcctccctagtagctgggattacaggcacacaccaccatacctggctaatttttgtatttttggtagacatggggtttcaccaagttggctaggctagtcttgaactcctgacctcaggtgatccacccgccttggcctcccaaagtgctgggattacaggtgtgagccactatacccgaccagatcaaatctttttttgacatttttgcaaaaaaattttcctaatgttcttgatttaattgtatagaatttgtataattaggtgtattttatttgcgtctagctttgaggtatcataatttatgtatcttatgtgaattttttgctgtaataccaataaagttttttttctccacatgttaa

SEQ ID NO: 18318 - DNA, 1704 bp, Homo sapiens
actcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataactcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctta

SEQ ID NO: 18319 - DNA, 1126 bp, Homo sapiens
ccagttatgcgaaaacatggctgcggccggtttggcccttctttgtaggagagtttcatccgccctgaaatcttcccgatcgttaataactcctcaggtccctgcctgcacaggattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaatagtctgtgtacaggagtaaatatgttaagtggtttataaagaaattctgtttttagtcaagtgactttactaatcagttgttctaagtgtgaatatggcatgctaattagctaatttggtagaagctaatttgcttctaaaaatcaggtataaagttcagatgagattcccactttataaattctgacatttaagcaggctttaaatgtcacctgctaccttagagtgtgaaggtgatggtaactgccacagcaaaggcaataccgtagtttttgaatttgaataatagttttacctctgttgttaataggctatgaagaggatgtgggtattgctgttaataaacggaggactttgattcaaaataatgagaaa

SEQ ID NO: 18320 - DNA, 673 bp, Homo sapiens
cgcgttttgccagttatgcgaaaacatggctgcggccggtttggcccttctttgtaggagagtttcatccgccctgaaatcttcccgatcgttaataactcctcaggtccctgcctgcacagggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaa

SEQ ID NO: 18321 - DNA, 1370 bp, Homo sapiens
ggaaacgcgttttgccagttatgcgaaaacatggctgcggccggtttggcccttctttgtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaatagtctgtgtacaggagtaaatatgttaagtggtttataaagaaattctgtttttagtcaagtgactttactaatcagttgttctaagtgtgaatatggcatgctaattagctaatttggtagaagctaatttgcttctaaaaatcaggtataaagttcagatgagattcccactttataaattctgacatttaagcaggctttaaatgtcacctgctaccttagagtgtgaaggtgatggtaactgccacagcaaaggcaataccgtagtttttgaatttgaataatagttttacctctgttgttaataggctatgaagaggatgtgggtattgctgttaataaacggaggactttgattcaaaataatgagaaatacatttagtccttaaagtagtaatcacagtgcacaacagtccaaaatatatttctggaatggctaatttttatttaattctgtaagcctaaggtaaaaagcataggcagtaacttttactagtcaataaaaagcagttctaccaatccactggtaattaatacactaaa

SEQ ID NO: 18322 - DNA, 1536 bp, Homo sapiens
aggccgaggcgggcggatcacctgaggtcgggagttcaagaccagcctgacaaacatggagaaacctcatctctagtaaaaatataaaaattaggcgggcgtggtggcgggcacctgtaatcccagctacttggagacagaattgcttgaacccgagaggcggaggtggcagtgagctgagatcgtgccactacactccagcctgcgcaacagagcgagactccgtctcaaacaaacaaaaaagtcagatctgtgctagacgctgaaaggaattaatcagacaggatctcagtcttttaagaactttcaaatacagagaagaggtggtaacaaatcattagtgtataatattgtaagcgaaaaattagaattgtgtgctaagtactggggtaacacagagatggtaattaattctttctggagaaacagcagtgaatgtgacaacctgagtgagggtggaaagcaggagaatttctagactctgaatttcagaagcttccggaactaaaatgatgtggaagttgagtgagtctcggtgggatattgctgctgcacctggtcaaggccgttccttcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgtatatgta

SEQ ID NO: 18323 - DNA, 1560 bp, Homo sapiens
tggtcaaggccgttccttcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtagatgggactgtctagttgcaggaaaacaagctcagggcttccactgattctacattatggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgtatatgtatgtgtgtgtgagagagagaaattggcccatcctgtggagtatctttaagagattctatattctggccaggcaccgtggtgcatccctgtaatcccagcactttgcgaggccgaggcaggaggactgctcgaggccaggagcttgagaccagcctggcaacattctgtctttaccaaaaacattcttttttttttttccgaaacggagtctcgctctgttgcccaggctggagtgcagtggcacgatctagactcactgcaagctctgcctcccgggttcacaccattctcctgcctcagcctcccaagtagctgggactgcaggcgcccgccaccacacctggctaattttttgtatttttagtagagacggggttttaccatgttagccaagatggtctcgatctcctgacctcgtgatccgccagccttggcctcccaaagtgctgggattacaggtgtgagccactgcacccagccaaactttttattttaattagctggacgtggtggtatgcacttg

SEQ ID NO: 18324 - DNA, 2019 bp, Homo sapiens
gctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaactgtc

SEQ ID NO: 18325 - DNA, 1906 bp, Homo sapiens
gcacagaaggctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctg

SEQ ID NO: 18326 - DNA, 3332 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctataaaagaaacataaaagtatgttgtgtattactgacagttctagattaatttcttttagaattaaagtagatttgttaaagtgtattgtgtgttgtaaattttttaagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaataagttgcatttattctctttcccagggttactcctttgaagagggcaaaattcagttgggaatataaattctggaatcttcatgaagaaaattagttaacagtatagacatgccctacaaatatcatccacaggcacttcattcaagaacttcaggtgtcagagtgcctggagctctggagcttagacattagagttgattccttggggattggttccaggacacctacttggataccaaagtccacagatgcccaagccccttttataaaatgatgtagtatttgcatattatgtatgcacatcctcccatatactttaaatcatctttagattacttatactgaatagaatgtaaatagtatttacaattgtgaatacaatgtatttagttatgtaaatatgtaaattttaaagttatgtaaatatgtagctatgtaaatagctataaaataatatttacaattgtgaatagtatgtaaatagttgtgaacataactattgtgaataatatgttatatgttatagttgtgaatgtaaatagtattcacaattgtgaatacaatgtaaatagctttcacaattgtgaatacaatgtaagtagctatgtaaatagtgaatacaatgtaaatagctatgtaaatagttgttatgctgattagggaataatgagaaggaaaaaaagtatacatattcagtacagatgcagtcatctttttttcccctcgaacatttttgatccacaattggttgaatccacagatggggaacacacagtcttggtaaatttaaccaacaaggagggtaaacgcatcccaacagggaaggtaaactgcacatccatcagtacctctagagggcatcactggtttatagctcaatacagtgactatatcagaataatggcctttagttttcctgaaagattaaattaggcttgctgttgttgaatgagataatcaaacatatgatgtaattttaaagggtttacatacagaaggcctgctgtatgtcctgcttctgctgtgtaaaagattcagcatggaatcattggaattttatgtacaggatttcattatctcattttctatacaatttttccttctgatccagagacacggaaaaacaaagggcaagatggaaataagggatgagaaggtctatgtggaaaaacagttacaactggagtggtaactgcaaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttctgcatgcttcaaaagctgattatgttttgagaacatggatctagatgctggtattgaggtgggagacaagtactgccacctgaaacaacagtcttggtaaatttagccgacgagggtaaacacatcctaacagggaaggtaaactgtacgtccatcagtaccactagagggcatcactggtttatagttcaatacagtgaatatatcagaataatggcctttagttttcctgaaagattaaattaggcttgctaacttgtttaatgagataatcagacatatgatgtaattttaaagggtttacatttttaaaaatttaatgattgctacataaaaagggtatcagttaactaattttacttagatggaacttctgtaagcttagtaggtatgcttaaataaagcctgctaataaaatagagattcagactcaatagaatggttttacatatgtaatatatgttttaaactgcataaaataaactcctccctcctttc

SEQ ID NO: 18327 - DNA, 1026 bp, Homo sapiens
atctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcaggggttactcctttgaagagggcaaaattcagttgggaatataaattctggaatcttcatgaagaaaattagttaacagtatagacatgccctacaaatatcatccacaggcacttcattcaagaacttcaggtgtcagagtgcctggagctctggagcttagacattagagttgattccttggggattggttccaggacacctacttggataccaaagtccacagatgcccaagccccttttataaaatgatgtagtatttgcatattatgtatgcacatcctcccatatactttaaatcatctttagattacttatactgaatagaatgtaaatagtatttacaattgtgaatacaatgtatttagttatgtaaatatgtaaattttaaagttatgtaaatatgtagctatgtaaatagctataaaataatatttacaattgtgaatagtatgtaaatagttgtgaacataactattgtgaataatatgttatatgttatagttgtgaatgtaaatagtattcacaattgtgaatacaatgtaaatagctttcacaattgtgaatacaatgtaagtagctatgtaaatagtgaatacaatgtaaatagctatgtaaatagttgttatgctgattagggaataatgaga

SEQ ID NO: 18328 - DNA, 1136 bp, Homo sapiens
gtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgaattttcttgaaatctcagttttggggaatcttagcgacgagtcgcggacctcagcttgtccggcgctccaaaacttccggcaggcggaccggaagcactgaggcgggaagggtggtagaggcccctcctgccggaacccggggggcggggctcgtggctgttgcggatggggcgtaggtgggcggtgcgcccacagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaatttgatagccacatacttttgttttcctctagatgctgcctctactcatgtagactatgaagtcttgactcatcctagatcttaggatcttaggtttgggcttcacaccacttgccttttacagtctagctatacctaattcctttaaaaagaaaagttggtgaga

SEQ ID NO: 18329 - DNA, 1118 bp, Homo sapiens
ttccggctaccccggctactcctgctcagcatggctgctttagggactgttctcttcacaggtgtccggaggctgcactgcagcgtagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagaaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactccgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 18330 - DNA, 1111 bp, Homo sapiens
ggctaccccggctactcctgctcagcatggctgctttagggactgttctcttcagtgtccggaggctgcactgcagcgtagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagaaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactccgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 18331 - DNA, 333 bp, Homo sapiens
atggctgctttagggactgttctcttcacaggtgtccggaggctgcactgcagcgtagccgcttgggcgggcggccagtggcgactacagcagggactggctgccaacccctccggctacgggccccttaccgagctcccagactggtcatatgcggagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctca

SEQ ID NO: 18332 - DNA, 586 bp, Homo sapiens
gctcagcatggctgctttagggactgttctcttcagtgagtgggtatagatagggaccgtggactcgggggccctttggggacgggcacaggacccctgatccggctgcgcggcctctcccccaactctgctctgttctcccagcaggtgtccggaggctgcactgcagcgtagccgcttgggcgggcggccagtggcgactacagcagggactggctgccaacccctccggctacgggccccttaccgagctcccagactggtcatatgcgggggtatgatcctgcttaattggataattggtgactgaggaagatggtgaagattttttctacttgttatttactatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcct

SEQ ID NO: 18333 - DNA, 895 bp, Homo sapiens
cggctactcctgctcagcatggctgctttagggactgttctcttcagtgagtgggtatagatagggaccgtggactcgggggccctttggggacgggcacaggacccctgatccggctgcgcggcctctcccccaactctgctctgttctcccagcaggtgtccggaggctgcactgcagcgtagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagaaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtgggg

SEQ ID NO: 18334 - DNA, 398 bp, Homo sapiens
tttagggactgttctcttcagtgagtggcaggtgtccggaggctgcactgcagcgtagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctca

SEQ ID NO: 18335 - DNA, 1162 bp, Homo sapiens
gctagaatgcacttcaacttaagtcctgggagctacgctaattcatggagaaccacagaggtttaataggcatttctatacctggatcagccccaaggacagtattaccctgtactgcccttcctattactattttcagtcatttactaatattgggctgtagtactttcacgtttaagctttggctattcagagctcactacgtttaatcttcagttacctgaatggtgtttaccttctggtgtggatcatcccggcttgtgttagtgctctctctttggaagaagccaggatttaagatcgagttagcctagatgtggcccagcagggtacagaaggggaaaggctgcagaaaacgggcgtattttcgtgcaaagaggtttttgcgccatttatttatggttttcaccgtcgtatgagaggactattcatgataggctgtatttgctgacagcctactttgggctcccccatgcgttgtgccgaaaccacctctttctttcctgccttcctccgcctgggctaggaagcccagagctgcggttcgcaggcctgctaagcagccggcggccggaagtctatcccgcagaagcgcagccattcacggcctcacgcaatgcgacacttccgcctgcacgagttcttccggggcggaggtcaccatggcagctgccttggctcggcttggtctgcggcctgtcaaacaggttcgggttcagttctgtcccttcgagaaaaacgtggaatcgacgaggaccttcctgcagacggtgagcagtgagaaggtccgctccactaatctcaactgctcagtgattgcggacgtgaggcatgacggctccgagccctgcgtggacgtgctgttcggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaaccctgctaccacaatgtttctggaacaagactagatca

SEQ ID NO: 18336 - DNA, 622 bp, Homo sapiens
gaaacgtgcacttgcaagctgcccgcaatacgtcatggcgaccaaacgccttttcggggctacccggacgtgggccggctggggggcctgggagctcctaaaccccgccacttccggaagactcctggcccgggattatgccaagaaaccagttatgaagggggccaaatcgggaaaaggtgcagtgaccagcgaggccctcaaggaccccgacgtatgcacagatcctgtccagctcaccacatatgccatgggcgtcaacatctacaaggaagggcaggatgtacccctgaaaccggatgctgagtaccctgaatggctgttcgagatgaacttgggtcccccaaagaccctggaggagctggaccccgagagccgggagtactggcggcggctgcggaaacagaacatctggcgccacaaccggctgagcaagaacaagaggttgtagcatggagggcccggcatcgctgacccccacgccgagggcttgccgttttcccggaggacgtggacttttgtgagacaagaggcggctccccagcctgggtttccatgtgaccccacagtggggctggaccagggccctggaggccaataaagagctttctgggtagaccct

SEQ ID NO: 18337 - DNA, 632 bp, Homo sapiens
agtgacgtcgtgggctgcagcgcagcagcacccaacgcatctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18338 - DNA, 722 bp, Homo sapiens
gcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18339 - DNA, 744 bp, Homo sapiens
agtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18340 - DNA, 661 bp, Homo sapiens
gcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18341 - DNA, 1361 bp, Homo sapiens
agtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggcctggcagcctcttcctggctagggggccagaacgcctctgaccacagcctgtggctcctgaggaagccccgaggctcatcctgccccggcacgggtcaccagctctgccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctg

SEQ ID NO: 18342 - DNA, 723 bp, Homo sapiens
cttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttgggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18343 - DNA, 834 bp, Homo sapiens
tgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18344 - DNA, 990 bp, Homo sapiens
aggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttgcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18345 - DNA, 1212 bp, Homo sapiens
gggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggtgagtggcgtggtgattacatgtgtcttggaagcatcctgggctgggatttgataagaaaccattaggtggaagaaccttccttttaaaaaagatctcttcattctctgcctagcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18346 - DNA, 660 bp, Homo sapiens
caggaaaggagagggagctttccccgaagaccctcctggaccagccccaggctcctgtgctgtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18347 - DNA, 705 bp, Homo sapiens
gcagtctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggcctggcagcctcttcctggctagggggccagaacgcctctgaccacagcctgtggctcctgaggaagccccgaggctcatcctgccccggcacgggtcaccagctctgccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18348 - DNA, 641 bp, Homo sapiens
ccccatgcagtctagcaggaaaggagagggagctttccccgaagaccctcctggaccagccccaggctcctgtgctggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18349 - DNA, 644 bp, Homo sapiens
ccccatgcagtctagcaggaaaggagagggagctttccccgaagaccctcctggaccagccccaggctcctgtgctggcggttctgagaagtccaagggttgctgggagaggttgcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18350 - DNA, 603 bp, Homo sapiens
ccccatgcagtctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18351 - DNA, 630 bp, Homo sapiens
gctgcacctgtgataagcccttgtccccatgcagtctagcaggaaaggagagggagctttccccgaagaccctcctggaccagccccaggctcctgtgctgcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18352 - DNA, 726 bp, Homo sapiens
gcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtgaccaacttctgcttttggaaaaacctctacaggcggttctgagaagtccaagggttgctgggagaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18353 - DNA, 565 bp, Homo sapiens
agtgacgtcgtgggctgcagcgcagcagcacccaacgcagttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18354 - DNA, 603 bp, Homo sapiens
agtgacgtcgtgggctgcagcgcagcagcacccaacgcagcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 18355 - DNA, 685 bp, Homo sapiens
cgcagcgcctgccagtgacgtcgtgggctgcagcgcagcagcacccaacgcatctagcaggaaaggagagggagctttccccgaagaccctcctggaccagccccaggctcctgtgctggcggttctgagaagtccaagggttgctgggagaggttgcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgg

SEQ ID NO: 18356 - DNA, 1253 bp, Homo sapiens
agtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctg

SEQ ID NO: 18357 - DNA, 864 bp, Homo sapiens
cgcagcgcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggcctggcagcctcttcctggctagggggccagaacgcctctgaccacagcctgtggctcctgaggaagccccgaggctcatcctgccccggcacgggtcaccagctctgccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgg

SEQ ID NO: 18358 - DNA, 544 bp, Homo sapiens
cagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgg

SEQ ID NO: 18359 - DNA, 882 bp, Homo sapiens
tgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgcttggtgttgtggttgccccacatacattaaagttaccagaagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactg

SEQ ID NO: 18360 - DNA, 1296 bp, Homo sapiens
ggcgcgccgcaggcagcactggcgggggcctttcctgccgccgacgccggggtcctccctcaggtctcattctgtgcctgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagaagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaagtaa

SEQ ID NO: 18361 - DNA, 2110 bp, Homo sapiens
ggtcgggaccggcaagatggcggcgcggacagcgttcggtgctgtgtgccggcgcctctggcagggattggggaatttttctgtaaacacttctaagggcaatacagccaaaaatggtggcttgcttctcagtaccaatatgaagtgggtacagttttcaaacctacacgttgatgttccaaaggatttgaccaaacctgtggtaacaatctctgatgaaccagacatattatataagcgcctctcggttttggtgaaaggtcacgataaggctgtattggacagttatgaatattttgctgtgcttgctgctaaagaacttggtatctctattaaagtacatgaacctccaaggaaaatagagcgatttactcttctccaatcagtgcatatttacaagaagcacagagttcagtatgaaatgagaacactttacagatgtttagagttagaacatctaactggaagcacagcagatgtctacttggaatatattcagcgaaacttacctgaaggggttgccatggaagtaacaaagacacaattagaacagttaccagaacacatcaaggagccaatctgggaaacactatcagaagaaaaagaagaaagcaagtcataaagcctcagggaggccatttttgcctaaatttgaaatgagggtgggccagatgagtatgtttaagtggagagtgcttccagctgagatgatttgagtctgccctaactgctccattgagttctcgtgccctcatcagctgagggcagggaatggaactttaatggaagaaccacttttatctattctttttattcattgtttcagttctgatttcagcaaacatgagcaaaccactttgactgaaagcagaaagagtgaaaattctattttgttacgctactggtgttcaattattagtttgtaccatttttaatttatgtcagttgatgcatctgaaaataagtgcttggagtgttcgtacccttatttttttttaagattcctagaaggaatctttggttaattcagattgagcagttaaagtttttgctatttacctttgtgcaggctggcatatgctaatttgggggtggtaaccaaccgattttatctcatgtaagcattacattttgaagactgaatatacttcacagcagatcaaacacatttatggcatgcactgacctcttcttggagcccagaactttatagagttgcctaccagggttactgtaatggaatttatgatcttaagaaattactagttgtattatttatcctatgattcattcattcaataagcttttactgcataaactttacatccagcactgtagttaagtacccaaaattgaatagaaataatggcttttgaaaatcgcacaaagcaggccaggcacggtggctcacgcctgtaatcccagcattttgggaggccgaggcaggcggatcacgaggtcaagagatccagaccatcctggctaacacggtgaaaccccgtctctaataaaaatacaaaaattagctggacatggtggcacgtgcctgtaatcccagctactcaggaggctgaggcaggagaattgcgtgaacccgggcccggtggaggctgcagtgagacgagatcgcgccactgcactccagcctggcgacagagcgagacgccgtctcaaaaaaaaaaaaagaaaattgtgcaaagcataggtaaatatttttctttattaagcttctcactgagaagccctctttattttggtaaatgtcactctgtttgttaggagatgtctgcttttccatgaaatgaaatagtggctaaagccctgaaagaggcaagactacaatgggctgaaacagttggtatagcaaccccagagaagtgcttcattttctttttatagtagaagcaggtccatgtcttttgtggtttcctgcacatctttggagtagttatgacttctcagtttttccccccttaaactgcattgcctattcttttttcctgacatgctatcaggtatcagtgtgttgaatacatactgcttgtgtatcagacttacgttactgtcatcaccattaaaagaattgcagctttgtgccccatgaccttca

SEQ ID NO: 18362 - DNA, 1862 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcataattttgagattttttgctttcagagttacgtaattcctaattcctcttgaaaaagagagtgtgaaatgaggtgaggcctcagatgaaagtaaaatataaatgtgagttgctatttaccagacacttctggtttcagatatttcttttctagccccttacccaagatttctagagctaatcctagtaacttttcttattaatgacttataatttggccccaaattggagctttttgccacctacctctggattctgatggatttcgccattatgggcatgtttaaagttagccctaaacacaggattttctacaagtggacagtcaaactccccacactaaagtggcagtcatcgtttacactccatgggcttcagcagtcccagcactaacgagagagtgccctaaaagcggggagggtagagttgtacaaaacatgattcttggccaggcacggtggctcacacctgtaaccctggcactttgggaggccaaggcgggtggatcacttgagtccagttagagaccagcctgggcaacatggtgaaaccccctctctactaaaaatacaaaaattaaccaggcatggtggtgtgcgcctgtaatcccagctactctggaggctgaggcatgaaaatcgcttgaacccaggaggtggaggctgcagtgagctgagatcatcctactgcactccagcccaggtgacagcgagactgtctcaaaaaaa

SEQ ID NO: 18363 - DNA, 766 bp, Homo sapiens
atgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacc

SEQ ID NO: 18364 - DNA, 1044 bp, Homo sapiens
cacaagcgccgcgccatggacgcagccatcttggaccgggaacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgt

SEQ ID NO: 18365 - DNA, 926 bp, Homo sapiens
gtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgt

SEQ ID NO: 18366 - DNA, 1075 bp, Homo sapiens
agctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagaggtatttcctttgatttaagccagaaagtcctgagagcggatcggggagcatttgcggatcggtcactttttcctcctttctgagtctcttatcccctaccacagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgt

SEQ ID NO: 18367 - DNA, 2115 bp, Homo sapiens
agtttgtagcggacaacatggcggccttcatgctgggctcgctgctgcggacgttcaagcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaagcaaagattttttttaatagaccaaaccctaatctctacaggggcccagtacagttgtttggcctacctgatgctatctctaaactacttttaaaatgaagacatttgggtgtttcatgtcagtgaattatcttttctcttggacttaacaaacatactgttcccatacatagtacaaagagtagcataataaatattttctgtgaatgttttttataccctccttttaagtttaatcttttagtaacatataggggtttttgtattaagagcattatttcataaaatgctatcttatacataatccaactaattgacatgtagctcatgtatggcagtttgtaatcctggactagctttgctgacctgcagagctccccttaactattattgttagataaacagattggatagcaaggctgctgttctggattatctaatgctccacttcttcttgtgatggctgaacaaaagaaccactaagtgttttcttgtccatccttaagggactttaaaacaaattatgcctctttaagtccttgaaagtctccatctaaagaggaaaagtttgttggaacagtatatattccctatttttatgtttatttaatccataacagaaatgagtaagggtagcacaaagttctcattcagtaactcaacagtgtgatcatcagcccagtgataaaaatatacatactgaatggaagtacctacttaacatcaggaaaatattcctggagaacttaataaatcaggaggtgaggggtgagatttttttctgcacacagagggaacaaaagcacaaagaagcaaaggcactctgtagcatcagagaaccacagtcacttcagtagatcagaaatatgaagcacaagacaaggcccgtattgtggaggatctcacaaatcatgtgaaggaattaagactgacataccaggtattacagagttttaagcacaggaatgacatcatcagtttgtaatacaggtaagtgacagctgtgtggcagatggccatgagaggaaaaagctacaggcaagacaaccagttaggaggatgtcttagttgttgaggaagatgaaggcctgaactaacattgtggtattagtagaggagagaggacagatttttaaagttttaggaaagaaaattgggcaagacttacaagactgattatatctaagaggtaaagatggttctctgggttcctgataaaagtgtctagatagatggtagagggcaattccaagagggcaactccaagatagaaaatttggaaaaagaacaaatttaggggaaacagaagataagcgagttcaggttccagtcatgcggtgttggagatgcctgtgtcatctgatgaagactagtacgcagctggatagcagagtccgaaactcaggtggaggtgaagttatgagggaattatcacaatctagtttggattcatatttcttaaatatgtatgacaacttaccaactggaatgttctagctaatatctcaacttagaatccatctcactaccaatgggcaaacacttgtgttctaaagttacttgcaagtagtttatactgccaacttgatatatatacatgctatagtttgaacattttgtgtacttccaaaattcacattaaaatctaatccacaa

SEQ ID NO: 18368 - DNA, 1006 bp, Homo sapiens
gtcacgccacctaatccattctctcggtcttcgtctgctccggtattgcaactgcctcgattggtcgatcctgggccagcatggcggcgcccatgtaacccggtccgtgccgcaaagcgaacggcggccgcggcgcgggccccgcgggggttagaggtcaccatgctgagggtcgcgtggaggacgctgagtttgattcggacccgggcagttacccaggtcctagtacccgggctgccgggcggtgggagcgccaagtttcctttcaaccagtggggcctgcagcctcgaagtctcctcctccaggccgcgcgcggatatgtcgtccggaaaccagcccagtctaggctggatgatgacccacctccctctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttctttctgtcttgaagaatgataggagagatgatggggctctttttggcctgaa

SEQ ID NO: 18369 - DNA, 866 bp, Homo sapiens
attgtgggaagtatagggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtctcaagtattcccatgtgttttaaaagcctgaagtcagtgagatgaaattcaacatcaagaatttgaagtaacttgtaaggaaaaataatataaagataccattggggcagtggctcacacctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaa

SEQ ID NO: 18370 - DNA, 2634 bp, Homo sapiens
attgtgggaagtatagggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctctttttttttttttttttgagacggagtcttgttctgttgccaggctggagtgcggtggtgcaatctcagctcactgcaatctccacctcctgggttcaagaggttctcctgcctcagcctcctgagtagccggggagctacaagcatgcaccaccacacccagctaattttttttttttttttgagaggagtctcgctctgtcgcccaggcttgagtgcagtggcgcgatctcggctcactgcaagctctgtctcctgggttcatgccattctcctgcttcagcctcccgagtagtcccaggagtagctgggactacaggtgcccaccaccacacccagctaatttttttgtatttttagtagagatggggtttcaccatgttatccaggatggttttgatctcctgacctcgtgatccgcccgccttggcctcccaaaagtgctgggattataggcgtgagccaccgcccgggcaaatttttgtatttttagtagagatggggtttcaccgtgttggccaggatggtctcaatctgaccttgtgatctgcccacctcggcctcccaaagtgctaggattactggcgtgagccaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacacctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaa

SEQ ID NO: 18371 - DNA, 996 bp, Homo sapiens
agtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgccgtaaagcgcggatgcgcggcgtggccacgccccttcagtgcttgtgacgcaggcgccctgggctttttgggcgcgaaaaagaagcagtcctgggttgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggtgagggcgacaaggaggacgccacccgccgcttccagatcctgggaaaagtctattccgttctcagtgacagagaacagagagcagtgtacgatgagcagggaacagtggacga

SEQ ID NO: 18372 - DNA, 1843 bp, Homo sapiens
atgcacggcctacgagaggggtagtgtgggactgagccaatgcgtacggcgtgacgccatcccgctgcgaccggcgctccccggggcaggtggctgcatagtcttggcggaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtgaagcgggagtggaagaaggatctaaagggaaaaactgacatgtttatgttatggaaaaagaaatttttctaagtttcatcacaaactgtgtccagtttctctgtggtgtttatgaaatagctaaaagcaaatgaagtaaagggcatactatggtttttcacaaaggtttatggtcgtgtttcaaattttcatcatttcagtgaacatacttccacgttacattaagtgtgcctagcagtctgttgcattttgtaagctcacagttttttgttttgagatggaatctcactctgtcacccaggctggagtgcagtggtgcaatcttggctcactgcaagctccgcctcccgggttcacgccgttctcctgcctcagcctcccgagtagctgggactacaggcgcctgccaccatgcccagctaatttttttttttttttttttggtatttttagtagagacggggtttcaccgtgttagccaggatggtcttgatctcctgacctcgtgatctgcctgccttggcctctcagagtgctgggattacaggcgtgagccactgtgcttagcaagctcactgttttagaaggttttatttttgtcttttgagacagggttttgctttgttgtgggggctggagtgcagtggtatgatcttggctcactgcagccttgacctccctggctctagcatctttccaccccagccttctgagtagctgggaacacaggagcgtaccactacacttggctgattttttgtaaattttgtagagacagggtctccctgtgttgcccaggttggtctcggactcctgggagcaatctgcccatcttggcctaacagtgctgggattacaggcctgagccactgtgcccagccggtttcctttatttcattcaaaggaattttgaatttatcttagaacctttattttgaaggaagaaagtcttttttttttttgagctggagtttcactcttgttgcccaggctggagtgcaatggcatgatctcagcccaccacgacctccgcctcccaggttcaagtgattctgcttcagcctcctgagtagctaggattacaggcatgtgccaccacgcccagctaattttgtatttttagtagggatggggtttctccatgtttgtcaggctagtcttgaactccggacctcaggtgatccgcccgcctgggcctctcaaagtgcttggattacaggcatgagccactgcatgtaatgaccagccactggtcagaattctttcaatcaagctgtgttaataagaatattgatgtgtggaaaataaaattttacaattct

SEQ ID NO: 18373 - DNA, 718 bp, Homo sapiens
cggggtattgctgccgggggaggatttgctggggacccaaggcaccctcgcgtgagagccctgagagcgaatcgcttcgtctgacctcggggttgtctggggcgagggcacgaatcaccccaacctttccgaagcctggtggaatggcttgtgaactgatctcaaaagcagcccaagtcatccgtcgctgggccggggagggggacaccgcggcggccccgccgagtgctacctgggcactgagcctgtggggagaggcgacccagcggggtggagagagataagggaccagtaacgtccagcgtttgtccgtggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagca

SEQ ID NO: 18374 - DNA, 785 bp, Homo sapiens
aggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcag

SEQ ID NO: 18375 - DNA, 1150 bp, Homo sapiens
ggacgagaggtcagggtaggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtagaaggccctggggaccaagaggggcagagggctgcaggcactctctccccacccagctgccccatgtttcagcccctcctggaagaaaagtggatatccggagtgttaattatactcaccacccaatgccaaccttcccgctcccttgggctttccctctggccccctcagagctgcagagggagctgcaaagactatcccctcttccccgccactcaggtctattaccaaatcacaggcctcggcttcctgaaggagttgttccgaagagcaaaccccaactcaaccggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggctta

SEQ ID NO: 18376 - DNA, 1062 bp, Homo sapiens
aggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtctattaccaaatcacaggcctcggcttcctgaaggagttgttccgaagagcaaaccccaactcaaccggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggcttacccattgggtgtgcgctcactgcttgggaagtgcagggggtcctgggcacattgccagctgggtgctgagcattgagtcactgatctcttgtgatggggccaatgagtcaattgaattcatgggccaaacaggtcccatcctcttcatgac

SEQ ID NO: 18377 - DNA, 803 bp, Homo sapiens
aggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtagaaggccctggggaccaagaggggcagagggctgcaggcactctctccccacccagctgccccatgtttcagcccctcctggaagaaaagtggatatccggagtgttaattatactcaccacccaatgccaaccttcccgctcccttgggctttccctctggccccctcagagctgcagagggagctgcaaagactatcccctcttccccgccactcaggtctattaccaaatcacaggcctcggcttcctgaaggagttgttccgaagagcaaaccccaactcaaccggtacctgacgcgctgggctcctggctccgtcaagcccatctacaaaaaaggcccccgctggaacagggtgcgcatgcccgtggggtcaccccttctgagggacaatgtctgctactcaagaac

SEQ ID NO: 18378 - DNA, 1532 bp, Homo sapiens
agcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattcgtcggaataaagttgttgggaatccctgccccatctgtcgagatcacaagttgcatgttgactttaggaacgtgaagctcttggagcaatttgtctgcgcccacacgggtatcatcttctatgctccatacacaggagtctgtgtgaagcagcacaagcggttgacccaggccatccagaaagccagggatcatggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctggtttgc

SEQ ID NO: 18379 - DNA, 1532 bp, Homo sapiens; identical to SEQ ID NO: 18378

SEQ ID NO: 18380 - DNA, 1252 bp, Homo sapiens
gtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattaacgtgaagctcttggagcaatttgtctgcgcccacacgggtatcatcttctatgctccatacacaggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctggtttgc

SEQ ID NO: 18381 - DNA, 1252 bp, Homo sapiens; identical to SEQ ID NO: 18380

SEQ ID NO: 18382 - DNA, 1532 bp, Homo sapiens; identical to SEQ ID NO: 18378

SEQ ID NO: 18383 - DNA, 1252 bp, Homo sapiens; identical to SEQ ID NO: 18380

SEQ ID NO: 18384 - DNA, 1252 bp, Homo sapiens; identical to SEQ ID NO: 18380

SEQ ID NO: 18385 - DNA, 1532 bp, Homo sapiens; identical to SEQ ID NO: 18378

SEQ ID NO: 18386 - DNA, 1252 bp, Homo sapiens; identical to SEQ ID NO: 18380

SEQ ID NO: 18387 - DNA, 1532 bp, Homo sapiens; identical to SEQ ID NO: 18378

SEQ ID NO: 18388 - DNA, 1252 bp, Homo sapiens; identical to SEQ ID NO: 18380

SEQ ID NO: 18389 - DNA, 1252 bp, Homo sapiens; identical to SEQ ID NO: 18380

SEQ ID NO: 18390 - DNA, 1532 bp, Homo sapiens; identical to SEQ ID NO: 18378

SEQ ID NO: 18391 - DNA, 1532 bp, Homo sapiens; identical to SEQ ID NO: 18378

SEQ ID NO: 18392 - DNA, 1213 bp, Homo sapiens
gtcctgggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattcgtcggaataaagttgttgggaatccctgccccatctgtcgagatcacaagttgcatgttgactttagggagtctgtgtgaagcagcacaagcggttgacccaggccatccagaaagccagggatcatggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgg

SEQ ID NO: 18393 - DNA, 1213 bp, Homo sapiens; identical to SEQ ID NO: 18392

SEQ ID NO: 18394 - DNA, 1213 bp, Homo sapiens; identical to SEQ ID NO: 18392

SEQ ID NO: 18395 - DNA, 1213 bp, Homo sapiens; identical to SEQ ID NO: 18392

SEQ ID NO: 18396 - DNA, 1213 bp, Homo sapiens; identical to SEQ ID NO: 18392

SEQ ID NO: 18397 - DNA, 1213 bp, Homo sapiens; identical to SEQ ID NO: 18392

SEQ ID NO: 18398 - DNA, 1213 bp, Homo sapiens; identical to SEQ ID NO: 18392

SEQ ID NO: 18399 - DNA, 1643 bp, Homo sapiens
agcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaagtggttgtatgatgccaatactgactcaaaccaacctttggatagaaaagtgtttgaggagtgaggtaaagaatgacacttccccttcataccaatgtccattaagcagattgcttatttaaaatgttaacactcatcacattttatctatgttgaataaaagtggttctgtgtgattgtcatttatatctgatccccaaatagctcatacaataatccattcaatagaatggaattaaaactgttcagaatgattttccaactagcaaatataagtatgcctggttaagatatcttccctttgtagaaatgttacattgggatggatagtggtgctgtcacagaaggacaaaatattcctagacgagtctaccctcaaaccagtagtgtcttttacatgaagagatgatttacacctaatagacattgaatatgatagacatacatgtatatatgtatcagttctgagttccactggcctatcccaaatacactggattaccaggcttgtactgtattcaaaatgatagatttgctaaatttcatgcaaaggactctaaactaggggagagattactgtttgtgttgtgttatagttgtgtaataattaaggctgccagatttagcaagtacaaatgtaggacaaatttaaattttagatgatgttttgcaaatttattgcatgatatccagcattttatctggcaactctagccataatgtacttctaaaaaagtatcacttaaggagaattttaatgactcagataaattttcatataaatttctttccatattttgaaaataaggctattcttgcttttccattttattttttaatagacatggtctcaatacgttgcccaggctggtctctaactcctaacttcaatcaatcctcctgacttgtcttccctaagtgctgggattacaggtgtgagccactgtgcctggtctcacttttccaattctaaagaatgtgtctgtgtaagccttcccctcaacaacttagtgaaaggtgaaaaaaaggtttggaaataaaagcatctgatgtttgaaaaa

SEQ ID NO: 18400 - DNA, 666 bp, Homo sapiens
ctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaagtggttgtatgatgccaatactgactcaaaccaacctttggatagaaaagtgtttgaggagtgaggtaaagaatgacacttccccttcataccaatgtccattaagcagattgcttatttaaaatgttaacactcatcacattttatctatgttgaataaaagtggttctgtgtgattgtcattta

SEQ ID NO: 18401 - DNA, 1502 bp, Homo sapiens
cgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccaagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatg

SEQ ID NO: 18402 - DNA, 1640 bp, Homo sapiens
aacctgccgggcgactccccaagggccgggaaggtcgggacggcgagagattccctgctgggaccgtcggaggtcccagccgcctggggacagcgctgtggctcctccgggcctgtaggcggcactgcggccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccaagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 18403 - DNA, 810 bp, Homo sapiens
cggaggggcccgttggggatgcggtggggagcgggcgtggtgcattcgggactcggcgccaggacctctatctacttccccccaggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggcc

SEQ ID NO: 18404 - DNA, 1078 bp, Homo sapiens
ttccggtgggctaggtactgagcgcgcgaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaagaaggcctccaaatatagaaacaatcccattagtcagcagtggaccctgtcttttattaagtgaaagaagaaactgagtctgaaagtactctaggagtagaatggtatttgccagggactggaggagggggcagtgaggagttattgtttaatgggtacagagtttcagtttgggcagatgaaaaagttcaggagacgatggcctggcatggtggctcacgcctgttatcccaacactttgggaggctgaggcgggcggctcacttgaggccaggagtttgagaccagcttggccaatgtggtgaaaccccatctctactaaaaatacaaaaaaaaaattggccgggcgtggtggtgcacgcctgtaatcccagatacttgggtggctgaggcaggagaattgcttgaactggggaggaagaggttgcagtgagccaagatcatgccactgcactccaacctgggcgacagagtgagactccatctcaaaacaaaaaaacggagatggatgatgaatggtgatggcggttgctcaaaaagttgaatgtacttaatgccactgaactatacccttaaatggtcacgatggtaaattttgtgttttactacaataaaaacttttttgaaagtc

SEQ ID NO: 18405 - DNA, 1463 bp, Homo sapiens
ggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaagaaggcctccaaatatagaaacaatcccattagtcagcagtggaccctgtcttttattaagtgaaagaagaaactgagtctgaaagtactctaggagtagaatggtatttgccagggactggaggagggggcagtgaggagttattgtttaatgggtacagagtttcagtttgggcagatgaaaaagttcaggagacgatggcctggcatggtggctcacgcctgttatcccaacactttgggaggctgaggcgggcggctcacttgaggccaggagtttgagaccagcttggccaatgtggtgaaaccccatctctactaaaaatacaaaaaaaaaattggccgggcgtggtggtgcacgcctgtaatcccagatacttgggtggctgaggcaggagaattgcttgaactggggaggaagaggttgcagtgagccaagatcatgccactgcactccaacctgggcgacagagtgagactccatctcaaaacaaaaaaacggagatggatgatgaatggtgatggcggttgctcaaaaagttgaatgtacttaatgccactgaactatacccttaaatggtcacgatggtaaattttgtgttttactacaataaaaacttttttgaaagtc

SEQ ID NO: 18406 - DNA, 1120 bp, Homo sapiens
tgataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttact

SEQ ID NO: 18407 - DNA, 1099 bp, Homo sapiens
atggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacat

SEQ ID NO: 18408 - DNA, 1065 bp, Homo sapiens
ggaaggtcagggaagggttcctggcaaatatgaccaaagctgagatctggttagccatgctaaggagaaagcaagaagcttctcaagcataggggacagtagcagatgtccagaaatgagactgagcacagatatttgggaacccattttggagcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaa

SEQ ID NO: 18409 - DNA, 1547 bp, Homo sapiens
cctcttcctgggcggcgatctctgggacagatgcgcagaagacttcctgctcaacgacgacgtcctccctgagagcgcccaggaaaacgtccacttccagcccagcagacgagtcgtcctgcgctcctgagcgttcgtcgacagagctcaggaggacctctgggatcaggatgagggtgtgtccatcgagagacactcgcaggatcgacgttggcgggagctccagcaccaggtcgacgtcgtccaggggcacacgcagggcacagcccgcggccaggaccactatggagcactttgagtatatcatcccactgtctcctggagggcaagattcagccttaagggggttcccttgtatgtgagtgctgcaagaactgggtgtgactcggaatccctcccaaccacttccggcgcaagtggcttctgataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttactaaa

SEQ ID NO: 18410 - DNA, 1401 bp, Homo sapiens
taatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccggtgttgatggaagtttcatctatgttatcttcagaacacatttagagactcctacacctctgaaaacttgagagtcagtactgtttggttaatttatacattaatcaggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttactaaatactgactacatttctctgttaatattgagctaaatgttaaaaaatggccagattaaaagatatcaatttgtagttctccctacaaagcaaaaattattaccctactcacttttcgtaggctacaaggatatttgagtgcctggttatgaatttctcaaatcatgttagatgagcgt

SEQ ID NO: 18411 - DNA, 903 bp, Homo sapiens
tagtcacgctcggtaccaggcgcagatcatggcaggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaagagaagttatttgtggaaacagggaaggctttattggcagaaggtgtcattttaagacgagtaggcgaagcaaggactcaacacggaggtagtcacgtttcccggaaatccgaacacttgagtgtcagaccacagactgcgttggaagaaaacgagactcagaaagaagttccacaggaccagcatttggaggcacctgcagaccagtcgaaaggtctcttgcctccctgaaggacctgtatactgtgtatgctggcattcacactctactcactggctgaatgttgagctatttttaaacagttgaactgtgtaaatgtttcttgatctctaaggtattatgtttgccttctcttagttatttctgggttgtcacaaagctcagtatcatggtttgacagaagcagttatgtgaacttttatgttaggacattactaaataaagaattccctagctgcttataaagtaaatttactttgaattgtaaataacatgaagaaacctttataaagattgttcaaatgggactcaa

SEQ ID NO: 18412 - DNA, 707 bp, Homo sapiens
gtccgcggtcgtccccacccctcagcgcgctgtggtacgtcccgcgctccgcttggcccaagatggcggcctccgtgtgcagcgggttgctggggccacgggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 18413 - DNA, 4586 bp, Homo sapiens
agcgtctcctgtgcgtctgcgcgggaagtggaacctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatggcccagccactgtgtgcattagcagggaggtttgtaggccatggaggaaatgaggagacaccacctagtggagacattggggccctgctggggggatggtgtctatagctggctctgctggctccctcaggccctgcttaccaagctctggaggagggagtgctgcattactgagcaccttccttgttctttcctcataggacactgatgttactgtcactttagttatgctaaagtggaggtttcagcctccagaagacagcagagccttctagggtcaccttaagaataggtttagctaggctgggtgtggtggctcatgcctgtaatcccagcactttgggaggctgatgtgggcggatagttgagcccaggagttcgagaccagcctgggcaacatggcaagaccttgtctctacaaaaagtacaaaaattagatgggtgtggtgtttcgcgtctgtagtcccagctatttgggaagctgaggtgggaggatctcgagcctgcgagatcaaggctgcagtgaatcatgatcgtgcgctactgcactccagcctgggccacagagcaagactgtctcaagaaaaaaaattttttaaataagtttaattataaagtgaaggaccagttggaccacggacccctagaaactcagccaaggagacctgactttatctgagacaggaaggcagtggttaaaagaattaaaaaaggacagtggtgcttgacagagcaggactgaagttttcattcctctacctgctggggccttggtcaagtcctaaaagctttccaggtctgtaactggttttgtctgtaaaatggggaaaaggttaccttttctgccacatgaagtagctggctggtgaaatgatgtcatactacgatgtgtttcattaactgttggagattatcacattaaattgagcagatttggatcttttacatttgatgctcaagtttgattctgtaccagatctgggtttggggtgatggcttgtcgggggtgggaggggaaggtgggcagagactgatgtataatggacaggtgttccttgagtgacagacttacaaagggagtgtttaattgaaatctagcatcttgtctctctgctatcagcattttggctgggtggaaaaagctctcctccacagagagccctcccatgtctgctggtttcagttccccacccaactgactgaagtcttgaccttgataccacctgcctgggcgttctacttggctgcaagggctcttcagaaagcacctagttccttttggctttcatctgcagtgtaggtctccatagctagtgacacacaaagccttatgagagtattccttccctctagggcccaaagaggctgctaaccagcaggaatgtcctgaaccaaaaggagtggtgaccattctctagacagaataaatgtctggtccctaatgggacagataactagggtttgagttcaggcttgacacaggagcaatgggcagtgaggtggacagcccagaccctgaaaggacgtgtggagacagcagcagtcctgtggtgcagttactgcctgtgtggccagcttcacaggcagcagataatttgtggaaataaacattattttctttttttgttccctgtaggctacttgatcctggatagtttctctttaaacctttgtctttccctattttgtttagtagtgatgaaagatgggtttaaaatatacagaaatgggagaaaattaattagagaaaatgtgaggattttataattgataacatgttcttaattttacttgcacaagcagtgttcacagccttattctgaagtgaccacttttcttctctttgaggcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagaggtcagatgacataatgaatatgttctaacttctgaaacttttggagcttgtttttgcccttgatagcacgtatccttagagaataagcttgccaatttaaggcctgtctgtaatggcatctgaatgttccagcagcctaactgtgctctgctccagaaacatgtgtgtggcttccctacctccacaccaaggagctgccttgctgggtggatgtaaagactgtcctgccagggtttcccactaaaggtattaataagtccagtggaccacagagggcccaatccctcttggccgctaaggctaaggtaggagccagagagctgtagagacaggaccaccaggatgcttcatgtccataacacaagagagcgctgcattgtttgggggccaggcattactactatcatgaagaaaaatgaagagcaggatgcatgttagtctttaattcacttttaatagtataaacctcatttaggtagtagtattaagccacaacaataatgccacattgaaacagcatttaataaaatgcataaagctaattcatgcactgcaatactctatatacaaacacaacaatgcaaattcttcttcaagactgaagacattgattagatataaaattcagtttaaaaagaacatgctattttttaaatgccatcacataaacaaagtgatttcacagggagaagaaagctgtataaagctgcagctttcaacaggttttaaacctggcattaaaatgtaatggcaaaaccaatattttctatattgtgaagggcaaaggttacagaaacggtcccaagaaaatctaacacccaaattttcctttgatagatagatgcctttaaaagggctggtaatgcagttacattctaacagagaagtccaaactacaggtaaaaactacggcttgtactgtgaaaaatgtgcagcttttcagttataaaactagttgaacactggtttacaagataatccgtagaacagagagactgtagaaaaatattccagcacttgagttgtgtgtggcagcagcatttgagtccatgaatgctatggtcattaaaataattgattatactttcctaaagaaaagccattttttaatgcaaagtctactacttccaaatgttattccaaacattaaattttaacagtctatcaatcaataaatgttgaacattttt

SEQ ID NO: 18414 - DNA, 590 bp, Homo sapiens
gaagtggaacctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgagtgagttgtttggtttgacctggaaggaacaaacttctcagcccagagaatttgaggaagaaaggggtgtgtgggaagggtgttgagaggcactacctggcagcaccatctaaacctgtatcatctgctgtggtcccagttact

SEQ ID NO: 18415 - DNA, 1281 bp, Homo sapiens
gcgcgggaagtggaacctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatggcccagccactgtgtgcattagcagggaggtttgtaggccatggaggaaatgaggagacaccaccta

SEQ ID NO: 18416 - DNA, 723 bp, Homo sapiens
tggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgagtgagttgtttggtttgacctggaaggaacaaacttctcagcccagagaatttgaggaagaaaggggtgtgtgggaagggtgttgagagggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggccca

SEQ ID NO: 18417 - DNA, 1119 bp, Homo sapiens
agctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgagcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagaggtcagatgacataatgaatatgttctaacttctgaaacttttggagcttgtttttgcccttgatagcacgtatccttagagaataagcttgccaatttaaggcctgtctgtaatggcatctgaatgttccagcagcctaactgtgctctgctccagaaacatgtgtgtggcttccctacctccacaccaaggagctgccttgctgggtggatgtaaagactgtcctgccagggtttcccactaaaggtattaataagtccagtggaccacagagggcccaatccctcttggccgctaaggctaaggtaggagccagagagctgtagagacaggaccaccaggatgcttcatgtccataacacaagagagcgctgcattgtttgggggccaggcattactactatcatgaagaaaaatgaagagcaggatgcatgttagtctttaattcacttttaatagtataaacctcatttaggtagtagtattaagccacaac

SEQ ID NO: 18418 - DNA, 1127 bp, Homo sapiens
agaggccacacggccgggcggggcgtgagggacagcccgaggactacaggtcccaaggttccccgcgccgcttccggggcacggtggcgtcccggcaccgcggccgcagtgaggagactcggccatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggatagcgaggctgcggcaggaggagcgggagcaggagcagcggcaggcgttggagcaggcccgcaaggccgaagaggtgcaggcctgggcgcagcgcaaggagcgggaagtgctgcagctgcaggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacacagcca

SEQ ID NO: 18419 - DNA, 2785 bp, Homo sapiens
gtccgtaacccgttggctgttccttttggtacgctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatgttagtgtactctttatctttggggaaagggaggagggagagggactcattattgttactatgattttgaggagtgtactttaaaccctcccccattaaactatgggatttattgtaa

SEQ ID NO: 18420 - DNA, 2628 bp, Homo sapiens
aacccgttggctgttccttttggtacgctccaagatggctgcctccatagtgcggcgcgggatgctcctggcgcggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatca

SEQ ID NO: 18421 - DNA, 1369 bp, Homo sapiens
acgctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaaaaagggagaatgctcatccagcaatccacagaattattccaggtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcct

SEQ ID NO: 18422 - DNA, 850 bp, Homo sapiens
caaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 18423 - DNA, 1678 bp, Homo sapiens
gcttaagttgacctctgggtccggaatcgcgggcaaagatggcggcggccaggtgttggaggcctttgctacgcggtccgaggctttcattgcacaccgcggctaatgccgccgccacggctacagaaacgacctgccaagacgtcgcggcgacccccgtcgcgcggtacccgccgattgtggcctccatgacagccgacagcaaagctgcacggctgcggcggatcgagcgctggcaggcgacggtgcacgctgcggagtcggtagacgagaagctgcgaatcctcaccaagatgcagtttatgaagtacatggtttacccgcagaccttcgcgctgaatgccgaccgctggtaccagtacttcaccaagaccgtgttcctgtcgggtctgccgccgcccccagcggagcccgagcccgagcccgaacccgaacctgaacctgcgctggacctcgcggcgctgcgtgcggtcgcctgcgactgcctgctgcaggagcacttctacctgcggcgcaggcggcgcgtgcaccgttacgaggagagcgaggtcatatctttgcccttcctggatcagctggtgtcaaccctcgtgggcctcctcagcccacacaacccggccctggccgctgccgccctcgattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagagtttgtgccattggattattctgttcctatagaaatccccactataaaatgtaaaccagacaaacttccattattcaaacggcagtatgaaaaccacatatttgttggctcaaaaactgcagatccttgctgttacggtcacacccagtttcatctgttacctgacaaattaagaagggaaaggcttttgagacaaaactgtgctgatcagatagaagttgtttttagagctaatgctattgcaagcctttttgcttggactggagcacaagctatgtatcaaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgagacaaatatttcttatgtcaacctgttattagatctcttactctgctcaaattcatcactgaaagatttaattttagttaccttttgttgatttaaaaataattgcatttgtatattgctaactgataagacaaattgagttattgagctattaaatgcacattttaatataaatgcagaaatcccaaataaaatgctaacatactgaattcagtaa

SEQ ID NO: 18424 - DNA, 1293 bp, Homo sapiens
tttcagttgtgttcttggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactag

SEQ ID NO: 18425 - DNA, 690 bp, Homo sapiens
gcgcgagcttggagccgggtagagggcgggccttccgggacgagggcgcgtgggtgaggaaggtcaggtctaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacctattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttattgtttga

SEQ ID NO: 18426 - DNA, 853 bp, Homo sapiens
gcaattactctcttccatattggttaacagtagaaggctcagtttctctgctcatcacacggccttcggcactgtagctttgggtggtgggctgcagattaattttgtaaccaccttaagaaaaatacggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacctattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttattgtttgatgatttgtttggggtgggatgggatgctgggggaatggaggggaaacctcattaagtgagcatcctatagtgtcctcatttctcccttcttgcttactgactcaccc

SEQ ID NO: 18427 - DNA, 744 bp, Homo sapiens
attcccaccaaaacatactaccgaaccgtgcatgcccttccaggagagccagacctttctaactctccccagcccaccacctccccgggtcctccgcacaggcggcggcgctagccttactgcgcaggcgccaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacctattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttat

SEQ ID NO: 18428 - DNA, 688 bp, Homo sapiens
agattgttcttgatgaactgaatgcagctaatacattttcagtgccgttgatgcctctatgactccgtaaaataatcggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacctattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttat

SEQ ID NO: 18429 - DNA, 402 bp, Homo sapiens
ccgggacgagggcgcgtgggtgaggaaggtcaggtctaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaagaaaaaaaaaaaaaaaaaagaga

SEQ ID NO: 18430 - DNA, 1040 bp, Homo sapiens
ccggccggaccgctgaggacgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagacgcctctttttcttcatcagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtacccag

SEQ ID NO: 18431 - DNA, 1024 bp, Homo sapiens
gacttccggccggaccgctgaggacgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtacccag

SEQ ID NO: 18432 - DNA, 1888 bp, Homo sapiens
gcttagcggccccaggcccgcccctgacactgaacgccgcttgtcccctccggcttgccgtcctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagctttccagtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttta

SEQ ID NO: 18433 - DNA, 1720 bp, Homo sapiens
gtcctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagaaggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttt

SEQ ID NO: 18434 - DNA, 1715 bp, Homo sapiens
ctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttt

SEQ ID NO: 18435 - DNA, 1286 bp, Homo sapiens
acagctgcccgggactccagtgatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttcctaatttatgtatcttggtcagcttctccacaagcttacctaattgtttatatactttatacttattaaagtatacatttttaaatgttagcctattaatttactcttgattatcaaacattaccagtgttgaactattaaaagcacacaatgtgtagtaaactatcataggattcccataatttcactttactttctgtttaggcatggaaaaatttatcagtcagaattgctgttttagggacatgattttcctgaaattgggtgaggatcagtgaaataattactctattacttgttcttaattctctgttctctaatgttttttcattcacaagtttactggagtataactggcttagtaagtatatcctactctgaatgataaaaatatagtcaagctaaaataggtgactatactattaagatagagatcatacaaaagattccaaagaaagtcaaaaagtgtaaaatggaaaataagagatcaaaatgaatatagcataggaataaagatttcactagaaattgcaatttattatgttttggaggttgtaaggaagtcttgttttttggtttattttactgttttgtgatcttgtatgcaaatcctgataaccattaaccttctcaaacttaatgtctgagagcctcataaaatcaacatatttacttattaagcagtttatgaaactttaatggggcccctcctgtgccaagggtacgtatattgtgaagtaaagcctcacaaa

SEQ ID NO: 18436 - DNA, 1652 bp, Homo sapiens
cgcccgcggggctgtccgcggtcgcgccgggctccgcctgcagtgtggcccgtccggacagtccctcaccccggcctgcgctgctgcgtggactcgggcctcaggaattccgctgcggcccaaggcttgccgtttgacgaggagcagtcgcggtaggcggtgggcaaggctgccctgggcggaggccgaggcgcggctcggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaaggttaaacgggagcgaggatggagtggaaactcatggggaggcatcagtcttggcccccctgaccctggtccctgtggagaaacatatgaggattttgataccaggatacttgaggtaagaaacgttttcactatgactgcgaaagagggaagaaagaaatcgatccgtgtcttggtggctgtggggaacggaaaaggagctgcaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttca

SEQ ID NO: 18437 - DNA, 990 bp, Homo sapiens
cggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcggccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcgttcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgtaggaatgtg

SEQ ID NO: 18438 - DNA, 1414 bp, Homo sapiens
ctgagaggagtgagtgccgtcaccgagggccgcgccagactgcgacggatacagggagggcaagggtttccttttggcgctcccctttggaccccggagtgaaaaactctaacgtccagatcagtggagagaaacgcagatttaggaccctgaggagtctttttcacccgtttcccgtcactcgctcaggcgcgccgagggcagtccttgtggggtcctcgtggccagccaagatggctgcccccgcagtgaaggttgcccgaggatggtcgggcctggcgttgggcgtgcggcgggctgtcttgcagcttccagggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgtgagctactgccacgctgaaaactacctgtgggttaaggatgtagttcctttgtaagggtgggcaggcctcgtaagaaagatgtagcagcatattcactatccgttaatccttctttctttgaggctggaacttgctctctctgcccctatttccttgtaaagagggagcacattgacttgggaatttcctccaggaaactcagggctgttttctcttcccttaggttggggcggacctttggatatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtgtg

SEQ ID NO: 18439 - DNA, 1500 bp, Homo sapiens
ccgagaagctcttgcacaggacagcctctggaaccccgcgccattagcgcctgcgccgtctctaggccccgccccctcacccctccggtcctggagctcccacagctaacatggcggcgccctgtgtgtcctacggcggagcagtttcgtaccggcttcttctctggggtaggggtagcctcgcccggaagcaaggcctctggaaaaccgcggcccctgagttgcaaacaaatgtcagatcccagatattaaggctaagacatactgcatttgtaataccaaagaaaaacgttcctacctcaaaacgtgaaacttacacagaggattttattaaaaagcagattgaagagttcaacataggaaagagacatttagccaacatgatgggagaagatccagaaactttcactcaagaagatattgacagagctattgcttaccttttcccaagtggtttgtttgagaaacgagccaggccagtaatgaagcatcctgaacagatttttccaagacaaagagcaatccagtggggagaagatggccgtccatttcactatctcttctatactggcaaacagtcatactattcattaatgcatgatgtatatggaatgttactcaatttagaaaaacatcaaagtcacttgcaagccaaaagtctgctcccagaaaaaactgtaaccagagacgtgattggcagcagatggctgattaaggaggaactagaagaaatgttagtggaaaaactgtcagatctagattatatgcagttcattcggctgctagaaaagttattgacatcgcagtgtggtgctgctgaggaagaatttgtgcagaggtttcgaagaagtgtaactcttgaatcaaaaaaacagctgattgaacctgtacagtatgatgagcaaggaatggcctttagcaaaagtgaaggtaaaagaaagactgcaaaagcagaagcaattgtttataaacatggaagtggaagaataaaagtaaatggaattgattaccagctttacttcccgatcacacaggacagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaataaaaggaaaataaagaatgttagtttca

SEQ ID NO: 18440 - DNA, 1353 bp, Homo sapiens
caggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaactcaagaacctggagctagctgctgtgagaggatcagatgtccgtgtgaagatgctggcggcccctatcaatccatctgacataaatatgatccaaggaaactacggattccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcagtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttccaaaaa

SEQ ID NO: 18441 - DNA, 2416 bp, Homo sapiens
gtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaaaccgtaattcctgggcacacatggcagctcagaaatgttgcctgacctactttgaggagatgatttgagcgaaacacccattctagcctggatgacatgaacatctccgtttggctttgtgcttagactcaagaacctggagctagctgctgtgagaggatcagatgtccgtgtgaagatgctggcggcccctatcaatccatctgacataaatatgatccaaggaaactacggattccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcagtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttccaaaaagtagaagtcatccctgtcgagaaggaccaacactgtgcactggtcagctcacagcaccaagaggcccccttcctgcttttctgtcatgtgttcccccagtaatcattttctgaccaccctgaaagcaaagcctgggtgggtactggcagtgcaaaggccagtaggccaccatccctggccccaagctgcacaagcccacagacgagggtcctgtagaacaaacgctttgatgtgcttctcaggtagcctgcggcccagtccagggcttggggaggatcagctgcatggaagagtgaatgccaggctgaggtcatcagggccctgaggaacttggacgtggggtcttcactctcatggaactgcccttctaactggagacatagacaatataccagtggttctcaaccagaggcaattttacccccaggagacatttgacaatgtctggggatatttctggctatcacagcttatgaaggaggttgctactggcatctagcaggcagagtgagtgctgctgttaaacccaccacaggacacagaacagtctactgcaacaaagaattacccaaggcctggcgcggtggctcacacctgtaatcccagcactttgggaagccaaggcaagcggatcacttgagcccaggagttcaaggtcaacctaggtaacgtggtgaaacaccatctctacaaaaaatacaaacattagccaggtatggtgctgtgcacctgtagtcccagctactcgggaggttgaggtgggaggatcacctgagcctgggaggtctagactgcagtgagccatgatcatgccactgcattccagcctaggcaacagagcaagaccctatatcaaaaaaaaaaaaaaaatctagccccaaatgttcaatgttcatgaggtcgttgataaaccgtgcattaaacaatctcacagtaattaccat

SEQ ID NO: 18442 - DNA, 1490 bp, Homo sapiens
gctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaactcaagaacctggagctagctgctgtgagaggatcagatgtccgtgtgaagatgctggcggcccctatcaatccatctgacataaatatgatccaaggaaactacggattccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcagtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaagattaggaaactaagactcagaaaagaggaaatgcttaaccaaaatcatatagtttataagggctccagagagtcagagctggcctcagtctctccgaactcaaagcctcttaaccttccagaacctccaccccacaacatgcctagacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttcc

SEQ ID NO: 18443 - DNA, 623 bp, Homo sapiens
gccaccctgggtgtcaatccctgcacagcctacaggatgttgatggacttcgagcaactgcagccaggggattctgtcatccagaatgcatccaacagcggagtggggcaagcagtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaagattaggaaactaagactcagaaaagaggaaatgcttaaccaaaatcatatagtttataagggctccagagagtcagagctggcctcagtctctccgaactcaaagcctcttaaccttccagaacctccaccccacaacatgcctagacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtc

SEQ ID NO: 18444 - DNA, 1997 bp, Homo sapiens
ctagccgctccggaccccagaggcggaagtaaaagcgaactacagtggatgggtgcagttcaggagatagctgttctccagcctttctggagggatgcagagcctttccttaggacaaacaagcatttcaaaaggtttgaactacctaaccattatggcaccaggaaacctctggcatatgagaaataactttctctttggttcaagatgttggatgactcgattttcagcagaaaacatcttcaaatcagtttcatttaggctttttggtgtgaagtgtcataatacagacagtgagcctttgaaaaatgaggacctactgaaaaacttacttactatgggagtagatattgacatggcaaggaaacgacagcctggagtttttcataggatgattaccaatgagcaggacctgaagatgttccttctttccaaaggagctagcaaagaagtgatcgctagcatcatatcaagatatccacgagcaataacacgtactcccgagaatctttcaaaacggtgggatctgtggagaaagattgtgacatcagaccttgaaattgtaaatattttggaacgttctcctgaatccttttttcggtccaataacaacctaaacttagagaataatataaagttcctctactcagttggattgacccgtaaatgcctttgtcgattgttgaccaatgcccctcgtaccttctccaatagtcttgatctgaataaacagatggttgaatttttgcaggcagccggtttgtcattgggtcacaatgatcccgcagattttgtcagaaagataatttttaaaaacccttttatcttaattcagagcaccaagcgggtgaaagctaacattgaattcttacggtcaactttcaatttgaacagtgaggaactgctggttctgatatgtggtccaggagctgaaatcctagacctttccaatgactatgccagaagaagctacgcaaacatcaaagagaagctgttttctcttggatgtactgaagaagaggtacagaagtttgtcttaagctatccagatgtgatcttcttggcagagaaaaagtttaatgataaaatagactgcctcatggaagaaaacattagcatttcacaaataatcgaaaatcctcgggttctggattcaagcataagtactttaaaaagtcgaatcaaagaattggtaaatgctggctgtaacttgagtactttaaacatcactcttctatcttggagtaaaaaaagatatgaagctaaattgaaaaagttaagcagatttgcctaaggatgccaatgtttttaattctcaggaactgtgaatatgttatgccacattgcaaaagaattttgcagaagtgattaatttaaaatgttattaagggccttgagatggggagattatcctgaattactttggagggcctaatataattgtagggatctttaaaagttgaagagggaggcaaaagaggaggtcagagtgatcctgtataagaaagacaactacttttgaaggaagttaaaaggtggctttgaaggaggaagacaccttgagccaaggaatgaagggggcctgtaaaaaaagattgaaaaggcaaggaaacagattctccattagagtccccagaaaggaatgcagccttgctggcacctttttagcccagtgagatcaatgtcaaacttctgacccacagaaccataagatggtaaatttgtgttgttttaaaccactgagtcagtgataatttgctgaagaagcaaatagattaacatagcaactaagtagatgattagttgcattataggtgaagtcaaaaatacagtcctttagtaaagtctctatttcttccttttataagagtaattatatttaaaaaatctacctacccttctggaattgctaatgttagtgtttataaagtcttaaatgtgtgcataaaaaactaaatgtgaatataaaatctaaataaaggaatatgtttgcctaa

SEQ ID NO: 18445 - DNA, 554 bp, Homo sapiens
aaaagcgaactacagtggatgggtgcagttcagggtgagattgggaagagatagctgttctccagcctttctggagggatgcagagcctttccttaggacaaacaagcatttcaaaaggtttgaactacctaaccattatggcaccaggaaacctctggcatatgagaaataactttctctttggttcaagatgttggatgactcgattttcagcagaaaacatcttcaaatcagtttcatttaggctttttggtgtgaagtgtcataatacagacagtgagcctttgaaaaatgaggacctactgaaaaacttacttactatgggagtagatattgacatggcaaggaaacgacagcctggagtttttcataggatgattaccaatgagcaggacctgaagatgttccttctttccaaaggagctagcaaagaagtgatcgctagcatcatatcaagatatccacgagcaataacacgtactcccgagaatctttcaaaacggtgggatctgtggagaaagattgtgacatcagaccttgaaattgtaaatat

SEQ ID NO: 18446 - DNA, 2528 bp, Homo sapiens
ggactgacctaccgaccattcttccgggtccagaaggtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatgtaagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaa

SEQ ID NO: 18447 - DNA, 955 bp, Homo sapiens
cggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaa

SEQ ID NO: 18448 - DNA, 2947 bp, Homo sapiens
cggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatgtaagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactc

SEQ ID NO: 18449 - DNA, 2386 bp, Homo sapiens
gacctaccgaccattcttccgggtccagaaggtgatctccgcccgtgctcagaatccaggggcccggggctgtagagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatgtaagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaacgtgttgtttgtttgaaggtagaaa

SEQ ID NO: 18450 - DNA, 437 bp, Homo sapiens
atcctcaaagcttataagcgagtatcaagacatgtgatatggttttaaaatagctgatgataaagtatatacatcatctcattttctcctcttagtcttgtaataggaaggacagatattcaaacacttatttatttatttatttttaacagagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaa

SEQ ID NO: 18451 - DNA, 580 bp, Homo sapiens
cagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagt

SEQ ID NO: 18452 - DNA, 566 bp, Homo sapiens
aagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctggtaagttccaaagcttccagctcacattcagacgttttccctaacgcaactacgtatttgcaacatacttttttcagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaact

SEQ ID NO: 18453 - DNA, 517 bp, Homo sapiens
agaatccaggggcccggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaa

SEQ ID NO: 18454 - DNA, 583 bp, Homo sapiens
gcagacagtcccacccccagcggcgacagcaactctctgaattccggaaagaaccttttccagcgggaccggaagcccggcggggaccgtagcggggacggactgacctaccgaccattcttccgggtccagaagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaac

SEQ ID NO: 18455 - DNA, 1675 bp, Homo sapiens
gtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaaaagaaaagaac

SEQ ID NO: 18456 - DNA, 1558 bp, Homo sapiens
cgggtttgtcgggctgaaatgtggcgggtctcggaaggttccgacctcagtaaagagagctaacgtgtattcttctttttcttagcgtgttgctttgtcgcccacgctggttgcagtggtgcgatctcagttcactgcaaccttcgcctcccaggttcaagcgattatcctgcctcagcttcccgagcagctaggactacaggtgtgtgccatcacgctcagctaatttttttggtatttttagtagagatggggttttcccatgttggccaggctggtctcgaactcctgacctcagatgatctgcccgcctcggcctcccaaagtggtaggattacaggcgtgagccactgtgctcggcacattttgatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaaagacagagtcttgctctgtggcccaggctggaatgcagtagtgtaatcatagctcactttaaccttgaactcctggactcaagcaatcctccaacctcagcctcccaagtagctgggactacaggcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtaggcatattgaggaatttgcctgtaggagatactgaaaattattttacctctgatcttgattagaaccatattgtcccatttttttttgaaacttttggtgtatatctactaaacactgtggcataggctcatcaatcacagtggcttactattatagcagagttgttagctaggagaagacagtagaaaggagggaagcatttgcttagggagaaatatgtgaattagagaaaattcccctgaggaacttagatacgtatcttgcctcaaaatcatttttctctattattgaaagcaaaggtatattaaggtttttactttaaataactttataaaataatataagtattactaatt

SEQ ID NO: 18457 - DNA, 1948 bp, Homo sapiens
gtactcacagttctttcctgatcttccccgccgcctcctgtattgcctctttatggaatcactccatatactgagttacacagcatggtttgcccgtgctgctgccccgcgggctgtcgcttctgacctgcctacactcagaactttccccaaagcatcagagtaatactgttactgtgatgggtaatggagaagtcgtgctgttctcagcgtgttgctttgtcgcccacgctggttgcagtggtgcgatctcagttcactgcaaccttcgcctcccaggttcaagcgattatcctgcctcagcttcccgagcagctaggactacaggatctcagctaaacgggaagcatttttgaaaagtgattgcacaattgagagtgaaaattactgagtcctgaacaggcaacttacattctaataccagctctgtctccatccagccgactgaatagtcgtgattaaatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaatt

SEQ ID NO: 18458 - DNA, 1865 bp, Homo sapiens
cgtgatctcgggtttgtcgggctgaaatgtggcgggtctcggaaggttccgacctcagtaaagagagctaacgtgtattcttctttttcttagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaattaatcgaagtcacatttcctgacctaagaatttattttaggtttcctgtaaagtacaatccaactcatcaagtagaaaataagcatgcatcattgaaaagagaaagtattgagaattgattgtgtcatttaggacaagtcacttgttctctttatatgccttttttccccagccatctatgaattaatttaaatatatttttaatctactacttcaggaaaatatggtaaaatttagtaaaatatgaattttagacttccttataaaccttttatttaaatacaaag

SEQ ID NO: 18459 - DNA, 1740 bp, Homo sapiens
aacccggaagaagtgaaccaggaagtgaacgtgatctcgggtactcacagttctttcctgatcttccccgccgcctcctgtattgcctctttatggaatcactccatatactgagttacacagcatggtttgcccgtgctgctgccccgcgggctgtcgcttctgacctgcctacactcagaactttccccaaagcatcagagtaatactgttactgtgatgggtaatggagaagtcgtgctgttctcagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggctcagtctcattccacgggtggtagtcgtgaccctgcacattccacattcctatccttggattctgtgagatcacctggtattctcattatgacttcttctgttaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaa

SEQ ID NO: 18460 - DNA, 4539 bp, Homo sapiens
gtaggcggggcgagccggctgggctcagggtccaccagctcacccgggtcgaggggcaatctgaggcgactggtgacgcgcttatccacttccctcctcccgcctccccctggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccatgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaatcc

SEQ ID NO: 18461 - DNA, 1806 bp, Homo sapiens
gtaggcggggcgagccggctgggctcagggtccaccagctcacccgggtcgaggggcaatctgaggcgactggtgacgcgcttatccacttccctcctcccgcctccccctggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaatcctt

SEQ ID NO: 18462 - DNA, 489 bp, Homo sapiens
agtcaatcaatagccaacctcaacctgagacaggacagaagagaactcagaatctttttgtcttttggacttcagccatgtccatgatgcctaccctgtgaagatctctcaccatccaaaaaattgtgccagcagacgatccgtggatccattttattttccctgctaggagttgctgtacataacactggcgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaa

SEQ ID NO: 18463 - DNA, 4531 bp, Homo sapiens
atgatgcagtgggagtccgagcctctgcgtcgtccgcttgggacgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccctggggtggcgctcgctggtgacgtagtgagtgtgatggccgccgcgaggccgggaaggtgaagcgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccatgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaatcctttgtg

SEQ ID NO: 18464 - DNA, 2672 bp, Homo sapiens
ggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaa

SEQ ID NO: 18465 - DNA, 2371 bp, Homo sapiens
agaaatggcgtggcaggggacccagcgagcccagagggattttgccgctgcttcctctacccctgtatttcacgcagctctctaaattgactcagctccaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacca

SEQ ID NO: 18466 - DNA, 1828 bp, Homo sapiens
gacagaaatgtggccattaagaagctcagcagaccctttcagaaccaaacacatgccaagagagcgtaccgggagctggtcctcatgaagtgtgtgaaccataaaaacttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaa

SEQ ID NO: 18467 - DNA, 2154 bp, Homo sapiens
aattatatgctatattcttggcaagatctttttcttctcctttgccctcttctactccttccccccttctcctgtttctccttcttcccttcctccaactcttcttcatcctcctagcatgtagaatattcttatgccagtcactcatatctttacttaaagcctgattggcatgtgaccagagtagacagtatctaagattccgaaatagcattttctttaccagtatccttaatcaagtaggcaagagttctaaggaatcttttgttcttaattctgagttgctcttggatctctacagtgccgcgtatgatgctgtccttgacagaaatgtggccattaagaagctcagcagaccctttcagaaccaaacacatgccaagagagcgtaccgggagctggtcctcatgaagtgtgtgaaccataaaaacttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacc

SEQ ID NO: 18468 - DNA, 1955 bp, Homo sapiens
ttcaccggaaaacacagtagctgtagctgcacatagacgcttcctctttctgtttccccctcatccccctccctagacctctctgggctttgacgtcatgtgtgctcctttcggttgccatagcaaccccattccccaagccctctgtccgtctcctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtga

SEQ ID NO: 18469 - DNA, 3081 bp, Homo sapiens
attctgtgctgggatactgtgtcccctgcaaatgtcagagctcttttgaaaaaaaaatcagaaataagtatggcagtatatttgttagaatctatgtatttgtgccttcaacaaaataaatgtaatttactggaaaatctgtaagtaaatcaggctatagatattacaagaaaactatctatccatatatttttctcaccctccccaaacatttaaatctagagacctagtctctgcttttacccccttaaacagataacttcccagggtactgcaatttagccacagaaaaagaatggcttatgccacagcagtaggctctgaagcaatcacaaggttgtttacatgggctgcctttggtgcagagcctgacagtgtctgtacagcagccctgcctgcttctggccatgttgatgataacttttatgaacaaactgcaaggaagcaggctaagtcatatgggatagactacagttcaggtggaaggaaaacgagtgtaagtgcaccaggcattgccagcacaacatccaatatctccttctatccctcatcggctagttgtcggaccctggaagataacacagaatgcttatcaacatatttaaaatagttgcagtaaggaccatttctctcagagaagcttctgtgaattttctactttaggtgagcatatatgttacaaatatataacaaataaatatataagtatatcacaagcttctgactccacttcagaaccattagattttaggggctggatgctttggatgtagcggtttggctgcctctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacc

SEQ ID NO: 18470 - DNA, 4107 bp, Homo sapiens
cctttcggttgccatagcaaccccattccccaagccctctgtccgtctcctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaatttgtagaaagaacatatgtgatacttatgtaaagtgtggggcgagtgggtaacagttttcaggcacaaaatggtttggccttctgaaggcaggtgtgaataaaagctgagagtcttttctgtgacagtaaagagtaggagagactggagggtagtgtgtggtgtggactaagactgaaaggaggttattacccagatactaggagacactggtgtccctgttttagagatttggctctatacccatttgtcatttctcaattactggtcacaacaagaggccactggagaaagtggcaggtggtgaagcaaggttattgtgtgtgcttttgatgataagaatctctctctggaactgagcagaattgcctccatgtgaattccttcaacaaaaaaatgagcctgcctagactactttcagattgtggattgtgttttccatgtgtgggctgcttccctgattcatactctgccaaagttttattttgagaaataatattactttcctcttctgaaataaaataataataataataatgaaacccccaaaccacagtgtgagtctcaggttagcatttgaaaacatctccagagacattgttattcctcaggagtttccctgactccttaatgtggctgatgtttcatgtttatttatttattttaataagtatgagcaatcgaagggctgatcatctgagttttgtactgcagtagatgtaagagcaataactctgcccataaatttactgctgccaaatagttttagcaatatgagtttgtcttaaaagccatgaagcattaatgtcaatgtttagcaaaatctccagaatttagcttaaattaaattaaatgaaagtgctttcctgagcacttaaggaggcactgtgaaacatcttggttatgtacaaggcaataccaaggtgatctcagcaataatcaggcttcccttcttattcacttcgaagtatccatcacagttatttgcactctgaccatgttggtgctcactagagtggtgatatttcacctgaagaagtgaaagacaggaagtggatggttgatgagtgtgaactgattggcaaatagaatatccccaaaacagagcaaacaagaatgccagtgctctgaaaactgccttaaatataataatagggaactttctttctctcttcaagcaatagagaccacagggaactgcacccacctgcaccatcgccatgccagtggtgctgccattctgagattatttcacacagtcagattcagtacacgcagtcatttgtttaaaataaatagaagaacattcctttgtgcagcttgtcccctggaataaaaatggcccattttctcta

SEQ ID NO: 18471 - DNA, 2382 bp, Homo sapiens
ctctcttttccattttgttacagaaccataattatcatgtgatctagacctgatacattgtagatgaagaaacatgtcgacagagccactatctgcccaacatctgatgggtagtcatagtcacagtggaactgagactaaggtttccatttttatttgactatgcttcttcccaaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgttgacatgtggtcagtagggtgcatcatgggagaaatgataaaaggtgcagtgctgtttcctggcactgatcatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacc

SEQ ID NO: 18472 - DNA, 563 bp, Homo sapiens
agtgccttgggcctggcttttcgcgttcttcggactagccagaggctcaggttggtgaccgagcggcagagttcctagcgcctgcagtgtggtgaactccaacttttaggccaagttgaaaatgcagccgacgacccccacacttctaacttcagaatcaaaactatgaccctagggagtgaggaggagagtgaaaaatgcgctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggct

SEQ ID NO: 18473 - DNA, 581 bp, Homo sapiens
agctttcccagtgcctccagcagccctcctcaaggacccctgtgaggccaggcagaaatggcgtggcaggggacccagcgagcccagagggattttgccgctgcttcctctacccctgtatttcacgcagctctctaaattgactcagctccagagacaggatctagttctgtcacccaggctggatggagtgcagtggcattatcatagctcattgcagccagaaactcctgtgcttgagtgatcctcctgcctcagccttcccaatggctgggactacaggttcaaaccactaggacagcatttgccacattattgttccactaatgaaccacctcagtggctatggagatgaaattagaggcgcagggttggtgtgtggagatgggtattgacagtcaattctcccagataatataacaggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgt

SEQ ID NO: 18474 - DNA, 562 bp, Homo sapiens
gtaagtgcaccaggcattgccagcacaacatccaatatctccttctatccctcatcggctagttgtcggaccctggaagataacacagaatgcttatcaacatatttaaaatagttgcagtaaggaccatttctctcagagaagcttctgtgaattttctactttaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggcca

SEQ ID NO: 18475 - DNA, 550 bp, Homo sapiens
atgctggaaggggatgtttatgaacagatcccagaggggctgagtgtgtttttgctgtcattgtctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagct

SEQ ID NO: 18476 - DNA, 743 bp, Homo sapiens
ttcctctgctgttgcaaagtgtctttaatttgaggggctcctgttcttaaaaaatcctcacagtttcagtaaaacgattctggatagtgaggcagtaagaaattatatgtagagtgggaaaatcagctgcctccagcttcctgcctgctagccccagaacagcatctgctgttgagaggagtgtgtttgccatgctggaaggggatgtttatgaacagatcccagaggggctgagtgtgtttttgctgtcattgtctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaa

SEQ ID NO: 18477 - DNA, 569 bp, Homo sapiens
tttcccagtgcctccagcagccctcctcaaggacccctgtgaggccaggcagaaatggcgtggcaggggacccagcgagcccagagggattttgccgctgcttcctctacccctgtatttcacgcagctctctaaattgactcagctccaggttcaaaccactaggacagcatttgccacattattgttccactaatgaaccacctcagtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtg

SEQ ID NO: 18478 - DNA, 595 bp, Homo sapiens
attagattttaggggctggatgctttggatgtagcggtttggctgcctctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagat

SEQ ID NO: 18479 - DNA, 564 bp, Homo sapiens
ttagattttaggggctggatgctttggatgtagcggtttggctgcctctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaac

SEQ ID NO: 18480 - DNA, 722 bp, Homo sapiens
ggtgcagagcctgacagtgtctgtacagcagccctgcctgcttctggccatgttgatgataacttttatgaacaaactgcaaggaagcaggctaagtcatatgggatagactacagttcaggtggaaggaaaacgagtgtaagtgcaccaggcattgccagcacaacatccaatatctccttctatccctcatcggctagttgtcggaccctggaagataacacagaatgcttatcaacatatttaaaatagttgcagtaaggaccatttctctcagagaagcttctgtgaattttctactttaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgt

SEQ ID NO: 18481 - DNA, 489 bp, Homo sapiens
gccccggttgccatgacaaccagtgccttgggcctggcttttcgcgttcttcggactagccagaggctcaggttggtgaccgagcggcagagttcctagcgcctgcagtgtggtgaactccaacttttaggccaagttgaaaatgcagccgacgacccccacacttctaacttcagaatcaaaactatgaccctagggagtgaggaggagagtgaaaaatgcgctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttcta

SEQ ID NO: 18482 - DNA, 1331 bp, Homo sapiens
aaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgttgacatgtggtcagtagggtgcatcatgggagaaatgataaaaggtgcagtgctgtttcctggcactgatcatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctc

SEQ ID NO: 18483 - DNA, 4736 bp, Homo sapiens
gctgtcggggcgaccgcgggagctcgccgtgcgccgtggctgggaccggcctggccgagcgcgccggcgccgcggccgcagacaaagggcggctcgcgcccgggccgccacgctctcgggctctgcctcgggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagaccacatgtggtgcacagggaagaaacggctttagacagcagtctgcgggccccacctgggtggcaggatgccgagaaatcttgcagaggtagctccgaaaccatctggcccaactagcctcaactgacagctgaggaaaggcaattaggcccagagaggcagagacactcgcttaagatcacaggcttagtgtgaggacgagcttgaaatcccagtctcctggcccccaggccagggtctgtccaccatagaatgtcttcctctactggggtcgttctggctttttgttagaaacttggtctgagatgtttcttccctgtccattaccattcgatgttcttttattcagagcaatgtttcttgtattctgaaactggaaactgaaccagtttgtttctcctagtcaccaagcatactttcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcactttcctgacacgcaaagacacagccctctttccccactgggcgtcctaccccagtgaggttgaaggcaccaattccaagaatccctccaacctccctgccagcactcccccttcaccccacacccggcccccccacctaaccacagcgcctctccagacctacctcgggacctaatgttctctacatgaactgctcatttggaggacagcagtgaggtcctgccatagagcaaatgtgttaggagagaaggtttcacatgggacccaacatccttcatcaatactttcctgagtttgatcatccatttagccttgacaaacagcagaccctacagagatgtgttggagagcacgtcgtgaccttgggggcaaggaatccagaaaggtaggaagatatgaaaagagaggtgtcaacagcaagggctcttaggggtcaggcaccagcatggagacctcatgacaaaggaagggactcaaagcagcaatgcccctcatagtgtaggctaaggtgagtttggtgcatgcaaacctgtgtgctcacccacagagcatggggtaatggtgtgtagacacaggccctctgcagaagcgtggggtggggacactgacagcccctatctggtccccaggaacattctaccatttctgccactggtgttcagctccttctcttcccccaacactcccaaagatacccacaggaagtccagccagtttccaggtagaggattccaccagttggtcttgggctgcgttcaccctcacatcacagcaccttaaatctaatcagcaaactataatttgtacgttgaaacctgcaacacattagaaacttatatttaaaaacagaattaatcacactgaccaacttttaaatggaaaatatgtaaataggaagtgtttgggttttgttttttctttaagaaaaagaaatgtacaccactcctcatgtgccattttgtcctcagagggcggctttacttttttggtaaaggaacaagctgctggccttgaccaggagttcatatataactgttattacagaggaattgttataactactaatgtttttaaaaaatttattaaacattattaaacttgatcaggtcaggccaaataaagttttattggaacacaga

SEQ ID NO: 18484 - DNA, 1576 bp, Homo sapiens
gagctcgccgtgcgccgtggctgggaccggcctggccgagcgcgccggcgccgcggccgcagacaaagggcggctcgcgcccgggccgccacgctctcgggctctgcctcgggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagac

SEQ ID NO: 18485 - DNA, 2746 bp, Homo sapiens
acagctcggttccagcgagggctccgcccacccgcgggctccgcagaggagcagaggttgggcggccgcctcggttaactccgctgcagcccaaagcacgggaatcgcgggacagacaaacgagcggagggaagatacctagaagccaggaaaccgcgagctgcagtccaacttggccggaagctgcggagaggctcagccaccggaagtcagtggagggttcggccggacgctctagaatcccggaggaccgggatctctgtggttggccgtgacgggcaccctctaccggggatgacacattcccagagctcctgggaccaagcaaatggcggacacaattccctgggcggaaggggacttcgggagccagtagccaagctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctg

SEQ ID NO: 18486 - DNA, 3149 bp, Homo sapiens
acagctcggttccagcgagggctccgcccacccgcgggctccgcagaggagcagaggttgggcggccgcctcggttaactccgctgcagcccaaagcacgggaatcgcgggacagacaaacgagcggagggaagatacctagaagccaggaaaccgcgagctgcagtccaacttggccggaagctgcggagaggctcagccaccggaagtcagtggagggttcggccggacgctctagaatcccggaggaccgggatctctgtggttggccgtgacgggcaccctctaccggggatgacacattcccagagctcctgggaccaagcaaatggcggacacaattccctgggcggaaggggacttcgggagccagtagccaagacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctg

SEQ ID NO: 18487 - DNA, 2845 bp, Homo sapiens
gccttgggaggcggggcggagggggacggacagggcagctcaagacgctgaggtggtggctgcggcctttgaacaaacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctga

SEQ ID NO: 18488 - DNA, 3077 bp, Homo sapiens
cggctcccgccggcgagctggacagcggcgcgcgccaggcgtggctttctcggccggtgggctaggattggacgcagtaggtagaaggggcaggaccctccgcagcagtagctcagcgattggccaggagctggagggagcgtggccttgggaggcggggcggagggggacggacagggcagctcaagacgctgaggtggtggctgcggcctttgaacaagtaagtgagccaccctcggagacccccgcgctggggacgggaggccggcgagcctcgggacctctgaaagccttgaggaggcgcggggacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctga

SEQ ID NO: 18489 - DNA, 850 bp, Homo sapiens
gcggggagcacacccctgcgaagtgccgggcaccctttgggcggctcccgccggcgagctggacagcggcgcgcgccaggcgtggctttctcggccggtgggctaggattggacgcagtagacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacagg

SEQ ID NO: 18490 - DNA, 3050 bp, Homo sapiens
agtcccgcgggccgtgcgcggtgctgtgccgcgccctgccagacacaggtgcgcccgcctagcccgaactccgcggcggcggctgccctctcgccgcgcctccgcctccttcgcagccgccgcctcctccgcgccgcgctccgcccggatggccagggctgtgcccgagaatggcggagcgagaaagcggcggcctgggagggggggccgcgtccccgcccgccgcctccccgttcctggggctgcacatcgcttcgcctcccaatttcaggctcacccatgacatcagcctggaggagtttgaggatgaagacctctcggagatcactgatgagtgtggcatcagcttacagtgcaaagacaccctgtccttacggcccccgcgcgccgggctgctctctgcgggcggcggcggcgcggggagccggttgcaggccgagatgctgcagatggacctgatcgacgcgacgggggacactcccggggccgaggacgacgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgccgcggtctcaggacacactgaataataattctctgggcaaaaagcacagttggcaggatcgggtgtctcgatcatcctcacccctgaagacaggggagcagacaccaccgcatgaacacatctgcctgagcgatgagctgcccccccagagcggccccgcccccaccacagatcgaggcacctccaccgacagcccttgccgccgcagcacagccacccagatggcacctccgggtggtccccctgctgccccgcctgggggtcggggccactcgcatcgagaccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcctgtctgga

SEQ ID NO: 18491 - DNA, 2566 bp, Homo sapiens
atgctccccgatttcccttctcctagcacctgggcccctgggctactgctgccctctggcccagccctgctatctccctccgtcctgcaggacagcctctccctggggcgctcggagcagccgcaccccatctgctccttccaggatgacttccaggagtttgagatgatcgatgacaatgaagaggaggacgatgaggacgaggaagaggaggaggaggaggaggagggagatggggaaggccaggagggaggagaccctggctcagaggcacctgcccccgggccccttatcccctccccttccgtggaggagccccacaagcaccggcccaccaccctccgtctgaccacactgggggcccaggactcccaggaccccgaggcggccgcggggcccggcggcgtggagctggtggacatggagacgctcaaccccacgcgtgacaccatcacgccgctgtgggccgcgcccggccgcgccgcccgcccgggacgagcctgctccgccgcctgctccgaggaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcccgagttccagcgctgcagccatttcttccagatgaagaacatctccttctgcggctgccatccccgcaacagctgcgaggccccgcaaggagctgctttccagtgggagcgaggggtagaccggaagagggttttacagaccaggggtaacgtccagccccacctcggagctgggcaaggggctgccctgaatagggccacagagggtagcagcaccggctcagagaagggagagtggacgcccctggtcatcatggaattaactcagagcgtgaactcttgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtg

SEQ ID NO: 18492 - DNA, 3358 bp, Homo sapiens
cgcggggcggacgccgcagggcgtgtcacgaggtgagcggggcgggccgagcgccggcgcggggcgcggcgaggctcccgcaccccccgccgcagtcgcgggcctctcccggagaagatggcggatcgcgcggagatgttttctctctccaccttccactcgctgtcgccgccgggctgcaggcctccccaggacataagcctggaagaatttgacgacgaagatctgtctgagatcactgatgactgtggcctgggcctcagctacgactcagaccactgtgagaaggacagcctctccctggggcgctcggagcagccgcaccccatctgctccttccaggatgacttccaggagtttgagatgatcgatgacaatgaagaggaggacgatgaggacgaggaagaggaggaggaggaggaggagggagatggggaaggccaggagggaggagaccctggctcagaggcacctgcccccgggccccttatcccctccccttccgtggaggagccccacaagcaccggcccaccaccctccgtctgaccacactgggggcccaggactccctaaacaacaacggaggctttgacctggtgcgtccggcctcctggcaggagacagcgctatgctcacccgccccggaggccctcagagagctcccgggccccctccctgccacggacaccgggcccggcggggcgcagtcgccagtgcgcccgggttgcgactgcgaagggaaccggcctgcggaaccccctgcgccaggggggacttcgccctcctcagatcccggcatcgaggctgacctgagaagccgctcgagcggcggccgcgggggacgtcgcagcagccaggagctgtcctcgcccggctccgactcggaggacgcgggcggccgcctggggcgcatgatctcgtccatctcggagacggagctggagctgagcagcgatggcggaagcagcagcagcggccgctcctcgcacctcaccaactccatcgaggaggcctcgtcgcccgcctcggagccggagcccccgcgcgaacccccgcgccgccccgccttcctgcccgtgggccccgacgacaccaacagcgagtacgagtcggggtcggagtcggagccggacctcagcgaggacgcggactcgccctggctgctcagcaacctggtgagccgcatgatctccgagggctcctcgcccatccgctgccccggccagtgcctgtctcctgcgccgcgcccgcccggggagcccgtgtcgccggccggcggggccgcccaggactcccaggaccccgaggcggccgcggggcccggcggcgtggagctggtggacatggagacgctgtgcgcgccgccgccgcccgcgcccgccgcgcctcgacccggccccgcgcagcccgggccctgcctattcctcagcaaccccacgcgtgacaccatcacgccgctgtgggccgcgcccggccgcgccgcccgcccgggacgagcctgctccgccgcctgctccgaggaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcccgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtg

SEQ ID NO: 18493 - DNA, 2221 bp, Homo sapiens
cgcggggcggacgccgcagggcgtgtcacgaggtgagcggggcgggccgagcgccggcgcggggcgcggcgaggctcccgcaccccccgccgcagtcgcgggcctctcccggagaagatggcggatcgcgcggagatgttttctctctccaccttccactcgctgtcgccgccgggctgcaggcctccccaggacataagcctggaagaatttgacgacgaagatctgtctgagatcactgatgactgtggcctgggcctcagctacgactcagaccactgtgagaaggacagcctctccctggggcgctcggagcagccgcaccccatctgctccttccaggatgacttccaggagtttgagatgatcgatgacaatgaagaggaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcccgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtg

SEQ ID NO: 18494 - DNA, 3163 bp, Homo sapiens
atgctccccgatttcccttctcctagcacctgggcccctgggctactgctgccctctggcccagccctgctatctccctccgtcctgcaggacagcctctccctggggcgctcggagcagccgcaccccatctgctccttccaggatgacttccaggagtttgagatgatcgatgacaatgaagaggaggacgatgaggacgaggaagaggaggaggaggaggaggagggagatggggaaggccaggagggaggagaccctggctcagaggcacctgcccccgggccccttatcccctccccttccgtggaggagccccacaagcaccggcccaccaccctccgtctgaccacactgggggcccaggactccctaaacaacaacggaggctttgacctggtgcgtccggcctcctggcaggagacagcgctatgctcacccgccccggaggccctcagagagctcccgggccccctccctgccacggacaccgggcccggcggggcgcagtcgccagtgcgcccgggttgcgactgcgaagggaaccggcctgcggaaccccctgcgccaggggggacttcgccctcctcagatcccggcatcgaggctgacctgagaagccgctcgagcggcggccgcgggggacgtcgcagcagccaggagctgtcctcgcccggctccgactcggaggacgcgggcggcgccgcctggggcgcatgatctcgtccatctcggagacggagctggagctgagcagcgatggcggaagcagcagcagcggccgctcctcgcacctcaccaactccatcgaggaggcctcgtcgcccgcctcggagccggagcccccgcgcgaacccccgcgccgccccgccttcctgcccgtgggccccgacgacaccaacagcgagtacgagtcggggtcggagtcggagccggacctcagcgaggacgcggactcgccctggctgctcagcaacctggtgagccgcatgatctccgagggctcctcgcccatccgctgccccggccagtgcctgtctcctgcgccgcgcccgcccggggagcccgtgtcgccggccggcggggccgcccaggactcccaggaccccgaggcggccgcggggcccggcggcgtggagctggtggacatggagacgctgtgcgcgccgccgccgcccgcgcccgccgcgcctcgacccggccccgcgcagcccgggccctgcctattcctcagcaaccccacgcgtgacaccatcacgccgctgtgggccgcgcccggccgcgccgcccgcccgggacgagcctgctccgccgcctgctccgaggaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcccgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtga

SEQ ID NO: 18495 - DNA, 3380 bp, Homo sapiens
ggagtccgggcgaggtgcgcggggcggacgccgcagggcgtgtcacgaggtgagcggggcgggccgagcgccggcgcggggcgcggcgaggctcccgcaccccccgccgcagtcgcgggcctctcccggagaagatggcggatcgcgcggagatgttttctctctccaccttccactcgctgtcgccgccgggctgcaggcctccccaggacataagcctggaagaatttgacgacgaagatctgtctgagatcactgatgactgtggcctgggcctcagctacgactcagaccactgtgagaaggacagcctctccctggggcgctcggagcagccgcaccccatctgctccttccaggatgacttccaggagtttgagatgatcgatgacaatgaagaggaggacgatgaggacgaggaagaggaggaggaggaggaggagggagatggggaaggccaggagggaggagaccctggctcagaggcacctgcccccgggccccttatcccctccccttccgtggaggagccccacaagcaccggcccaccaccctccgtctgaccacactgggggcccaggactccctaaacaacaacggaggctttgacctggtgcgtccggcctcctggcaggagacagcgctatgctcacccgccccggaggccctcagagagctcccgggccccctccctgccacggacaccgggcccggcggggcgcagtcgccagtgcgcccgggttgcgactgcgaagggaaccggcctgcggaaccccctgcgccaggggggacttcgccctcctcagatcccggcatcgaggctgacctgagaagccgctcgagcggcggccgcgggggacgtcgcagcagccaggagctgtcctcgcccggctccgactcggaggacgcgggcggcgccgcctggggcgcatgatctcgtccatctcggagacggagctggagctgagcagcgatggcggaagcagcagcagcggccgctcctcgcacctcaccaactccatcgaggaggcctcgtcgcccgcctcggagccggagcccccgcgcgaacccccgcgccgccccgccttcctgcccgtgggccccgacgacaccaacagcgagtacgagtcggggtcggagtcggagccggacctcagcgaggacgcggactcgccctggctgctcagcaacctggtgagccgcatgatctccgagggctcctcgcccatccgctgccccggccagtgcctgtctcctgcgccgcgcccgcccggggagcccgtgtcgccggccggcggggccgcccaggactcccaggaccccgaggcggccgcggggcccggcggcgtggagctggtggacatggagacgctgtgcgcgccgccgccgcccgcgcccgccgcgcctcgacccggccccgcgcagcccgggccctgcctattcctcagcaaccccacgcgtgacaccatcacgccgctgtgggccgcgcccggccgcgccgcccgcccgggacgagcctgctccgccgcctgctccgaggaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcccgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtgaca

SEQ ID NO: 18496 - DNA, 2527 bp, Homo sapiens
cgcggggcggacgccgcagggcgtgtcacgaggtgagcggggcgggccgagcgccggcgcggggcgcggcgaggctcccgcaccccccgccgcagtcgcgggcctctcccggagaagatggcggatcgcgcggagatgttttctctctccaccttccactcgctgtcgccgccgggctgcaggcctccccaggacataagcctggaagaatttgacgacgaagatctgtctgagatcactgatgactgtggcctgggcctcagctacgactcagaccactgtgagaaggacagcctctccctggggcgctcggagcagccgcaccccatctgctccttccaggatgacttccaggagtttgagatgatcgatgacaatgaagaggaggacgatgaggacgaggaagaggaggaggaggaggaggagggagatggggaaggccaggagggaggagaccctggctcagaggcacctgcccccgggccccttatcccctccccttccgtggaggagccccacaagcaccggcccaccaccctccgtctgaccacactgggggcccaggactccctaaacaacaacggaggctttgacctggtgcgtccggcctcctggcaggagacagcgctatgctcacccgccccggaggccctcagagagctcccgggccccctccctgccacggacaccgggcccggcggggcgcagtcgccagtgcgcccgggttgcgactgcgaagggaaccggcctgcggaaccccctgcgccaggggggacttcgccctcctcagatcccggcatcgaggctgacctgagaagccgctcgagcggcggccgcgggggacgtcgcagcagccaggagctgtcctcgcccggctccgactcggaggacgcgggcggccgcctggggcgcatgatctcgtccatctcggagacggagctggagctgagcagcgatggcggaagcagcagcagcggccgctcctcgcacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcccgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtg

SEQ ID NO: 18497 - DNA, 4369 bp, Homo sapiens
ggcgcgagggtctgtcagaccgggcgccgcggcggcggcagcggcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgtggacatctggtctgtcgggtgcatcatggcagaaatggtcctccataaagtcctgttcccgggaagagactatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagcacagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtggacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgagctgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 18498 - DNA, 4326 bp, Homo sapiens
gcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagcacagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtggacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgagctgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 18499 - DNA, 1416 bp, Homo sapiens
atattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttggcgccatcattgcagtgccttgccattcattggcaggatgaggccagtcagtgtcattgtcactccatggattaaccaggaagggatgctgtgtgaggggttgggctggccatctcttccttggtgtctcacttcaactgtgtgtccagcccagaacgtcagaatcgttagtctgaccctgaacgttagtctcttgcatggtaagacggtcagccgccgcagcatcacgggccagctcaagtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcaggttagtgattgctttaattgatt

SEQ ID NO: 18500 - DNA, 2266 bp, Homo sapiens
ggagcggagcggggcgggccggcggcggagccggggccgcggagccaggagtgactagcacgcagcgccgccagtccgcccgcccgccctctccccgtggcgcggcggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccgtatccttccccgcgaccttggccccgccatgctttcttaatgcctcaggcagcatgaccacctgcttacacgagcgctcacgaggacaaagtcgtaaaatccactccagactgtgttctaaggggggctttactgtatttgttaattagtgtcacaagccaagtggttcaatttcattctttatttttaacttgactacctgtgatgactttgagacttagagttcagttaaaccgattatattagctcttaattttgccaaaaatagctggacacatagaagaaattatttactctttgataagtatattctgatatttaaatgaaaatactgtattatttagtttattccgttaatttaactaggaaagatgctatctaaatttaataggctagtgtgcttgtgtgctttaattaagtactattttgttagttactggtatgcattgaaatattttcccccaaagtaagaactgaagcacattacaaaggacctaagtgaaagagattaaaatgaaaattttgtgaggaacaatatgttaaactttcttgtttgttactgtgctgacattttgtagaattttttttaaaaatctgtctagtgggttattttgtgacacactggggaagtcaaaataaatgtaaaatgaaagagataaactcatactgtagtcagcaagtcatgttagagatacagcagaaaggagaataactactctaattgttacaatagccttctttcctcatttgccattcttccatcctcagtattttttaccctaacatggttcttcacatcttccctttttcatttgtgttttaaccacttagtttttcattagtctttgactttgttttcgttatgaaagtttaaattggtctccatccttgggcagattgatggttgcttttaaggaaatcaagctccatagtcagtgttttgtatgtatcttaggaaaataatttcagattttaataattttatcaaagtggtctccttataaattcttcacagtgcaaacttaaagtgaaaatatttttatttctctcattttatttacctttctttacattttctatatcatagattatataatatgtcaagttattttatttgttctactaaattttctagcagtttccatagcctcatctcagattcacttgttgcaacctataaataaggacgtctttattttgcaagtaaacttaattaaaaagggaaaagttgaaaaattaaaagactaataatttagaaatatctacttaatgttcagtttgtctcaattcttactcattttgtgccattccttgttttattacaaaatgttttcttcaaaaagtacaaaaatgaaaaatgtgagtactttttggtgcattttagtaagtaaaattaaaattcctgctata

SEQ ID NO: 18501 - DNA, 4815 bp, Homo sapiens
ggcgcgagggtctgtcagaccgggcgccgcggcggcggcagcggcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtggacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgagctgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaatgtatagcatgtccaatttttgtgtgtttttacatggcaattagatatttctccatcaccatctctgatgacagatttaacatgaacacagatagatgataaagtgtcatgcttttgatcaatattagcaagaggtttcacactgagaggcagaaacattgctgtttgttctcttattgaaaatattctgcaaattcctaaatctgtgttttcaaaactaatggcagtaagttttgacttcaccaatatgcaggtccaattcagagtattggtgtaattgttttctcatgaggcgtggccaggagaattcaccagtcagccttagtcatgttacttaacgtcattcatggtgcttgtggctttgtgcctgggatgagccaagttcatctgacgtctgtgtttgaagcacttcaggctgtttagtacttaataccacaggagtggaaggaca

SEQ ID NO: 18502 - DNA, 4336 bp, Homo sapiens
gcggcggcggcagcggcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgtggacatctggtctgtcgggtgcatcatggcagaaatggtcctccataaagtcctgttcccgggaagagactatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtggacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgagctgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 18503 - DNA, 657 bp, Homo sapiens
gagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcggcggggaggcgaggaatgttatatgcatggagttatacaggatgtgactttttgagattggcttttttcgttgactatcctgcccctgagatccacccaagttgtgggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgt

SEQ ID NO: 18504 - DNA, 1668 bp, Homo sapiens
atattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgctataaagtattggactctttggcactaaaaccccagattgctacaaaccgaaggctaaaatagagttgatatctggtcagtgggttgcatcatgggagagctggtgaaaggttgtgtgatattccaaggcactgaccgtatccttccccgcgaccttggccccgccatgctttcttaatgcctcaggcagcatgaccacctgcttacacgagcgctcacgaggacaaagtcgtaaaatccactccagactgtgttctaaggggggctttactgtatttgttaattagtgtcacaagccaagtggttcaatttcattctttatttttaacttgactacctgtgatgactttgagacttagagttcagttaaaccgattatattagctcttaattttgccaaaaatagctggacacatagaagaaattatttactctttgataagtatattctgatatttaaatgaaaatactgtattatttagtttattccgttaatttaactaggaaagatgctatctaaatttaataggctagtgtgcttgtgtgctttaattaagtactattttgttagttactggtatgcattgaaatattttcccccaaagtaagaactgaagcacattacaaaggacctaagtgaaagagattaaaatgaaaattttgtgaggaacaatatgttaaactttcttgtttgttactgtgctgacattttgtagaattttttttaaaaatctgtctagtgggttattttgtgacacactggggaagtcaaaataaatgtaaaatgaaagagataaactcatactgtagtcagcaagtcatgttagagatacagcagaaaggagaataactactctaattgttacaatagccttctttcctcatttgccattcttccatcctcagtattttttaccctaacatggttcttcacatcttccctttttcatttgtgttttaaccacttagtttttcattagtctttgactttgttttcgttatgaaagtttaaattggtctccatccttggg

SEQ ID NO: 18505 - DNA, 2347 bp, Homo sapiens
ctcctcctcctctcgccgctaccgccgtcgccgccgccgcagccgccgccagtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgacagcctctgcc

SEQ ID NO: 18506 - DNA, 2334 bp, Homo sapiens
ggagtaacagtgtcgccgccgccttcctcctcctcctctcgccgctaccgccgtcgccgccgccgcagccgccgccagtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgaca

SEQ ID NO: 18507 - DNA, 1988 bp, Homo sapiens
ggagtaacagtgtcgccgccgccttcctcctcctcctctcgccgctaccgccgtcgccgccgccgcagccgccgccagtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggtctcccgcttcgctgccctccccaagctcgtccatctag

SEQ ID NO: 18508 - DNA, 1783 bp, Homo sapiens
gaagttgcagccactctgctaagtgccctgcttggaaaggctgtgggctccctgctgagaaatactgcgagcggctttgtcagccggctgcctggtgccagttctgctgcagcctgggagggacactgtggcagagctcctggagagaaatgaggtttgcaggccattggagttggactggacatgatggagggtcactttccccagagcgatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtg

SEQ ID NO: 18509 - DNA, 1850 bp, Homo sapiens
agttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatatt

SEQ ID NO: 18510 - DNA, 2870 bp, Homo sapiens
gttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttgcaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaaaaatggtgccttcttctgcgtttgtccctcctgccatgtgtaagttgtaaggattgcctttgtagttaatgtactctttggctttgtttgtttgttttcttcttcagtgaagcagccttactattcatagaagggctagaataggagaaaatgaaaggtagtgagtaattctttgataagatgaggaaataatgggaaaggttgaattaattcctgggcatggactaccagatgaccacaagttgcgttgaggccgcatctttcttcagcagcgtgcaatagctggctcctctataggagatgagcttcattgggagttcctagcaagttgactaaacagcaaaagttctttctcgtgggtaaatatacccacaggttctatgatttgtagctctaggtttcttgatgatcaaggagtgaagtaattgacagggaaaatatagacctatgataaataaccaggaagcattgcttttggacaaggaaggacagagggttttgattttaaaaagaagaaaaaaaaaccttattttttctttcttggcctcaagttcaatatggagaggattgcttccctgaatcctctcttccttccccttttaga

SEQ ID NO: 18511 - DNA, 3435 bp, Homo sapiens
cgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacatcctgatcctggaggccatcgagaaccacaacctcgcagacacggtgctcaagatcacggacttcggcctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggagcttcggagccgtgaggaggagctgctgcgggcggcacaggagcagcgcttccaggaggagcagctgcggcggcgggagcaggagctggcagaacgtgagatggacatcgtggaacgggagctgcacctgctcatgtgccagctgagccaggagaagccccgggtccgcaagcgcaagggcaacttcaagcgcagccgcctgctcaagctgcgggaaggcggcagccacatcagcctgccctctggctttgagcataagatcacagtccaggcctctccaactctggataagcggaaaggatccgatggggccagcccccctgcaagccccagcatcatcccccggctgagggccattcgcctgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggctgaaggggctgggggaaggaagcaaacagtggtcatcaagtgcccccaacctgggcaagtcccccaaacacacacccatcgcccctggctttgccagcctcaatgagatggaggagttcgcggaggcagaggatggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcggacggggcgctggggcagcgggggccgcccgagcccgcgggccatggccctggccctcgtgaccttctggacttcccccgcctgcccgacccccaggccctgttcccagcccgccgccggccccctgagttcccaggccgccccaccaccctgacctttgccccgagacctcggccggctgccagtcgcccccgcttggacccctggaaactggtctccttcggccggacactcaccatctcgcctcccagcaggccagacactccggagagccctgggccccccagcgtgcagcccacactgctggacatggacatggaggggcagaaccaagacagcacagtgcccctgtgcggggcccacggctcccactaaggcctgcccaccaccgcccgcctgggcagccatgaatgtagcgccccaggccctgccccagcccgccatgccacaaggtgggggaggccctgggcaggatgttcactctatttattggggaaggagggaggggggggacacttaacttattcctttgtaccccagggggtggagccctgtgcccaccctgcactggggggagggtgggcagggatactcagggacagggcatcatgggggatttggcacaaaatggagcattaaaggtaacccctgccccct

SEQ ID NO: 18512 - DNA, 3566 bp, Homo sapiens
gaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgaggcgccggaggccccggggccccacccccccggcctgaccacactgccctgggtgccctcctccagaagcccgagatgcggggggccgggagacaacactcctggctccccagagaggcgtgggtctggggctgagggccagggcccggatgcccaggttccgggactagggccttggcagccagcgggggtggggaccacgggcacccagagaaggtcctccacacatcccagcgccggctcccggccatggagcccttgaagagcctcttcctcaagagccctctagggtcatggaatggcagtggcagcgggggtggtgggggcggtggaggaggccggcctgaggggtctccaaaggcagcgggttatgccaacccggtgtggacagccctgttcgactacgagcccagtgggcaggatgagctggccctgaggaagggtgaccgtgtggaggtgctgtcccgggacgcagccatctcaggagacgagggctggtgggcgggccaggtgggtggccaggtgggcatcttcccgtccaactatgtgtctcggggtggcggcccgcccccctgcgaggtggccagcttccaggagctgcggctggaggaggtgatcggcattggaggctttggcaaggtgtacaggggcagctggcgaggtgagctggtggctgtgaaggcagctcgccaggaccccgatgaggacatcagtgtgacagccgagagcgttcgccaggaggcccggctcttcgccatgctggcacaccccaacatcattgccctcaaggctgtgtgcctggaggagcccaacctgtgcctggtgatggagtatgcagccggtgggcccctcagccgagctctggccgggcggcgcgtgcctccccatgtgctggtcaactgggctgtgcagattgcccgtgggatgcactacctgcactgcgaggccctggtgcccgtcatccaccgtgatctcaagtccaacaacattttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctccccaca

SEQ ID NO: 18513 - DNA, 2830 bp, Homo sapiens
attctccaggcccacgagtcacaggactgaccagccagcccggcctgggcctgacctcccccagttctccccaaaaggactccccctcccaagtgggagacctggcccaggcctcccagaaaggagaagtagggaccacgggaggaaagcggaagaggtgtgagctgcccaggccactcccaagccccacagaggccagcccagggagggagctggtggccaggtccctatcagaggccagggagccctaaaggggcactgagagcttcccccagtttcggggtctctggcccattctcctctgggtgacccctgacctcccatgcctgggatctacatcagacaccagaacagcagttcgagttgggacagttgaaagcacagagaggagcttggagagaaagcagaggatggggcttagcagctggcagagccaggagcggggaggtagcagaaagaccacaagtacaaagaagtcctgaaactttggttttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctccccac

SEQ ID NO: 18514 - DNA, 3492 bp, Homo sapiens
agaaagctgaagctgacacccgtgcatccggacaccgcacgagcatcgcctgtgacagcgccccgggtccggtggagggcagcggggggaggagggaaggaggaggagaaggaggaggaggcgggagcagcatccggagcggagctgcagcagcgccgccttttgtgctgcggccgcggagcccccgagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccatgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggaatagcaaaccacgaaatcgcccatcattccgacagatcctgctgcatctggacattgcctcagctgatgtactctccacaccccaggagacttactttaagtcccaggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatataaattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaaagccagggttgtctttatattctttatccccaaataatagggggtggggggaggggcggtgggaggggcaggagagaaaaccacttagactgcacttttctgttccgtttactctgtttacacattttgcacttgggaggagggaggctaaggctgggtcctcccctctgaggtttctcaggtggcaatgtaactcatttttttgtcccaccatttatcttctctgcccaagccctgtcttaaggcccagggggaggttaggagactgatagcatgtgatggctcaggctgaagaaccggggtgctgtttaagtccctgcttttatcctggtgcctgattggggtggggactgtcctactgtaacccctgtgaaaaaccttgaaatataacactccatgcagg

SEQ ID NO: 18515 - DNA, 9876 bp, Homo sapiens
ccctcttttttttttcatgacacacaccacagcgaagtctgtgcggaatcctaaaccagcccaatttacatccattcatgaatctgtgacgtcagcaagcctttgggctcctttgcggtgggctggaggattgtgtgggtggaatccccctcccctttatttttccaattctgcaaggcttttaaaattcaccttacatcttttcaaagcaagaaaatggaacagcatgtgtaggaattcttcgttgttgttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgcttaaggcctgtatggaatatcattgggaaggcatattccactgattacaaattgcagcagcaagatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaagggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgagaaccccatgcagtttgaagaatcggactgtgactcttcagatggggagtgttctgatgccacagttaggaccaataaacactacagctctgctacctggtaatgaaggaatacacatcctgaagatctcgtgactatactggcatttcagatccaccccacccccagactcatcccactctctcccagcattttgtctgggaagagagactaccccatctttaccaccccctagaaatgagctgcaataacaggaacatgagacttcgcaaatctctggaaaataatatccaaatgaaattaagtctcactgaacatttcaatcaagaatggcagggatctattttattgaatattctagctactgtaacattgatatttatttttgtttgacattttaacactttgtactgcaaagagtgaactatatatgagatagagagacaataatttcttgcaaaaaaaaaaagagataaaagaaagaacagaaaaaaagaaataagtggaatttaagagcaacatccttgggaatttgtggggccgggaggtattattgctgcttgaacaggggaccaggtcttttggccataagtgactaaagaagagccagagcaagacattgaacattttagaacacaaagaacagcaaaagaaaagcaattccaggcaacttgtgaacagaccatattcacttcaaccagcttgtccaggtggcttacggaaatgacctagaaaagtctggtgaccagatacttgcacccaatgtcttcaagggcatgtgcttcctctaggagggaaaaacagacaaacaaacaaacaaacaaacctgtgtatgtggaagctggtttcatttttaaatgtttaagcagcagttggtagtgaggtttacagatagtgtcaaatcttgtttttggcaaatacgtccctttttagtgctgtcactgtcattaccttggcaaatgtgctaccttgacccaacgtgttgatctttcatactcaagtgccatttccttgtagctcatttcctttctgcctgctgaccacttcctgtaggaacaaaggttggggggcagtactgaggaggagaaaagggtgagagaggaagaacatctacagtggtgttaggaaaacgaacgtggaatttataaaactccattctcaggatcactcagttcagctacgaggagaagatggaaccacccctctctggagccaggttgcttgtctacttgagtcatattgattcaagcaggagaacagactttgaaggcagctaggatgtatgtgtgtctatacaatgtctgagcccaaaccatccctttgtttttattcaataactcattctatcttagaagttcttttttttttttttttttttgacagagttttgctctttttgcccaggctagagtgcaatggcacaatctcagttcactgcaacctccatctcccaggttcaagcgattctcctgcctcagcctcccgagtagctgggattacaggcgcccgcaaccacgcctggctaattttgtatttttagtagacacggggtttcaccatgttggccaggcttgtctcaaactcctgacctcaggtgatccgcctgcctcggcctcccaaagtgctgggattacaggcatcagccactgtgcccggcctatcttagaagtcttaatgactggctaccactgtcagaataaaagcaaaaacaagcagcttgcaaaaggcaactcctctcccagcacaatagcatttttgttcaatgctacttgtaaaatatcttttacttcactccaaatcaatgcagttttaaataactggatttgaacatttgtggaaagaacaagggatgctgagcagggataggaaggatttttacattgccaaaagcatgaggtcctgcctgtctccagggtcatgggctctgaaaagcattccaaggtacttcatggtgccttggccttaaggaaaaatttttttagaattttatgtacaaataggtgttgacctagtacctgtccctgtctccaagacagattaccgtcaaacaacctctctagattcactggactctttgacactgcatcatgttggacgttaggaaatacttgcacagacagctgttaaaccatttccaatgcacatgaaaatgttgccgctcctctgggttttactgattgcatcagccaaaaaggaaaggcaggagggaatttagagttccttttgcttgtttgatccatttgtttacactttatgttgatacattgatttaaaatgtagtgtctgtgatttatagctcttaggatgaaggaaaatgtttaatttatacaaagagcagtattgtttgcattaatttattccattttgtaaaaattctgtagctggactacatgaaagatcttaagttatggcattattatcattgttattttattttataatattatcattctcattttctgtcgatcagaaggtgtgatttatgatgtggcacaatggttgtgtttattgctaaccaggaattattatggattttatgattttaatgaaggaatgaaaatggaattcccatttgggagctccctggtattgatcttagctgtgttccctaattttctgtgtacaacaatcatctgaggacgcatgttctgccctgaagcccaatggatacattgtgattttgacttgatcatgaaagctcctgggtgggccgatgacccccaggatgtcaaatagtggatggacatatagttaaaaagctgtaaactttctaaagtttcttaggaaataaattcatgggactatattagaaataaaaagagaatgatttaatgtcctgagaggaacagacctagagggtttccgcacagggctcatggattcgtttcaagaattgacaacatagtttgcaatctccttcctgccagacccctttgttctcccacctttattctcctagtggagagtagcagggagactaaaaaaagaaatggtatacagtagtcccctcttacccatggcttcattttcatggtttcagttacgctcaacagcagtccaaaaatatttgatggaacattccagaaataaacaattcataaattttaattgcacagcattctgaggagcatgatgagatcttgccccttgctgccctggaggtgatcctccctctgtccagcatattcatgctgctcatccattagtcacttagtagcagtctcggtgatcagatcgactgtctcggttatcagatgactgtatcgcagtgcttgtgttcaagtacccctatttaattaataatagccccaaagggcaagagtgctgtgcctaatttacaaattaaattttatcatagatatgtaagtatagaaaaaaaaacatagtatatatagggtttggtactatcagagtttttaggcatccactgggggtcttggaatgtatcccccagaaataagggaggactaccgtatatacatgtagggcatgacataaaatgcctaactgtgatgtcatcctagaacaagactaaagaactttaagaaggaggcctggtcacttagaggaccaacgactggaaaaaaattcttgaaaggctatattttccatcctcttgacttcagatctcactgtactgtaaatctctctggttcattattccttggaacagagatgctacaactctatgtcttctttctatccaacataaaacactggcagttttgtccaattcttgcccacctttagtggcaacagagaaacatgagggtcagcttttatcttacatctttcagtgatggtcttcctagaaaacctacccctgatacctcgtaattttgatcagttttttttgaattctcatcttgattatctgttatgctattgtcatcatacaccttatgtggattaactgttatgagtatgttagggtagtacgtagtggctgaatctcagtcattcattgtatagtcgagagttgaataaagtccatattgaacacatttttttaagtagaattgactagaggtttcagaggagaataaggtccttagtggaggttaaaaagggaaataccttctctagcccagcctggtccttcgctgcctgccttgtgataaccgggaaaatcttgaattgatgtatgtttctttgagaacgactccacagtcatctgaagagtgttgaatcaagagctcagggaagttatgagctaattcttcagtcctgacaagtgtgttacaacagtgcttccaggaacctcacaagactgtgatttcaagctgcttcattgatggaaagtttcaccatcttgggatgaatgtccatgttccgttagcgtctgtttttaactgactgcaagatgatgagttttaatttgggttgcagatgagcatttggttctgattttcatctatttcaagatcatatcctctggataacagttccttttaaaattgctttgcagaggggctgagaagcctgcatctactttgaaattataatggaccttaccaccacttaagtttagacctgtttgcaagatggtggggagctcctactgagaaagatgaagatgctagctctattgtaaactggcgtcttcatctagctacttgaagttgagatactatattttaaaatgttggcatcaaacaaatctatccttctagaagtaaagacattttgagtaggatttagtaagtactggacatctcctgtagagcttcatcatgctaaattattcccctctccttttctaaataatagatgtgcttgggtttgggatttacctggcaccaacccagactttttttgggggggggtgagggcgcaggatctcactctgtcaccaggttggagtacagtggcatgattatggctcactgcagcctcaacctcctgggctcaagtgatcctcccacctcagcctcctgagtagctgggaccacaggtgtgtgccaccatgcacaacaattttttttttttttttgtagagatgggcgtctccctgtgttgcccaggctggtatcgaactctgggctctagcgatcctcctgctttggcctcccaaagtactgggattacaaacgtgagctgccatgcccagcctccagactattttaaatgccctctcccactgtggaacattggcatcctttaagaataaatgcatcctttttgatcaaatgatttactctttttttcttcaatgtcctcatgtctcaatttttttttccttttcttaaaacagtcccacttgaacttcctggaactgaattctccagaacataatatttataatccatagaattcctgccctgctctgcagtagagtgtgctatgttttgttttcccactgagccagaagccgaaatattatactaccacttaccaccatctaccacctccaagaccaagaccaacattatgtattgagcatcgtatctttcctactgagcctagacacagcctcagaacctctcaacatagcacttggagcaacaattgccgcttgattggaattgccatttgagcttgagttagccccaatggcagaacgacaggctcgcactagtgtccacctgtggctgtcaggggcggtaccacagaaaggggaaaggccacttgcctctacccactgcccttttggacaacaattccaattgaaggaacaccaatcactgatggatcccattccaaaatgtctcttcattcacatcatttaattctgttgaatgaatatgttcctccctcaccttttataaacagaaaattaatataagtcccagttacttgcttcttagactctgtgagactcatgtaccaaaacaatgtgacattcttttcgagactttgacttgtacggtcagtatgaatttagtgcctttccaggcagcaaaatgtttcttctttgctgatttcataggacaaatatcctagcatactcacaccaccagtgtcccaccctcacagactggcacattagaatcatattaatctgcttgtttgcatgttacaactgatactgcaaaagcctattcaagtcggactgaactaggctaagcagaggacccttgtggaacctggagcatttctcagggacaggtggctaaagaggggagctctaaaatcactgctctgagaaacaggaggtgggttaaggcttttgttaactgtcatgtggccagggtacgatggcaggacttcacagagcagagccctaagcagatggcaaggccactgtaaggaagctcccggcagcatcccaggtctgctctccagagccacttcacagcactcagggatcgctggctcccggccctaggctgctgtccagtgaccaggtggacagggtcctccagtgactgcaggccaagggaaccccagccagcatgtgcaagctattaggaagatgtcccatcttgcccatatcaccccagtggctcttcaccttcagagtgaccacttcccagactctggaagtgggaagaccctctttgacgctttattacagtaatttgagctcctatcgacttggagcgaatgaatttctcttttgtggttaggtctccaaatgaacctccttacctggctcccctctggtctcctgtactgtcagtccccagctcccagtgttgttttctgatgccggctccctctctgtattgaacggcaatgggaacaagaatgactatcaaagcaaacaaatgcatggaattaaacaaaaagtgtacttcactg

SEQ ID NO: 18516 - DNA, 3156 bp, Homo sapiens
tgggtggggcggagcgtctgggatgcgctgggagcctaggatccccgacagaacactgaaatctatggactctaaaatggacttcatttaaagaaacccacggaccattaatggacaaaaacatgagtcaatatgtattgtggcattcaaatcctagcactctgggagaggttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgcttaaggcctgtatggaatatcattgggaaggcatattccactgattacaaattgcagcagcaagatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaagggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgagaaccccatgcagtttgaagaatcggactgtgactcttcagatggggagtgttctgatgccacagttaggaccaataaacactacagctctgctacctggtaa

SEQ ID NO: 18517 - DNA, 573 bp, Homo sapiens
aaagtttagtttagtctgtgaggaaactggcggctgctggtagttccatgctgtctgttcagacttcagcttggtgttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgctt

SEQ ID NO: 18518 - DNA, 618 bp, Homo sapiens
gtggagggtgacgccatgggtggggcggagcgtctgggatgcgctgggagcctaggatccccgacagttttgcagaacactgaaatctatggactctaaaatggacttcatttaaagaaacccacggaccattaatggacaaaaacatgagtcaatatgtattgtggcattcaaatcctagcactctgggagaggttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaact

SEQ ID NO: 18519 - DNA, 2824 bp, Homo sapiens
atgtcttatgttgagtgcaagtgtttacagttagaaaataaaaatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaagggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgagaaccccatgcagtttgaagaatcggactgtgactcttcagatggggagtgttctgatgccacagttaggaccaataaacactacagctctgctacctggtaatgaaggaatacacatcctgaagatctcgtgactatactggcatttcagatccaccccacccccagactcatcccactctctcccagcattttgtctgggaagagagactaccccatctttaccaccccctagaaatgagctgcaataacaggaacatgagacttcgcaaatctctggaaaataatatccaaatgaaattaagtctcactgaacatttcaatcaagaatggcagggatctattttattgaatattctagctactgtaacattgatatttatttttgtttgacattttaacactttgtactgcaaagagtgaactatatatgagatagagagacaataatttcttgc

SEQ ID NO: 18520 - DNA, 2737 bp, Homo sapiens
acctggttgtggagggtgacgccatgggtggggcggagcgtctgggatgcgctgggagcctaggatccccgacagttttgcagaacactgaaatctatggactctaaaatggacttcatttaaagaaacccacggaccattaatggacaaaaacatgagtcaatatgtattgtggcattcaaatcctagcactctgggagaggggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgagaaccccatgcagtttgaagaatcggactgtgactcttcagatggggagtgttctgatgccacagttaggaccaataaacactacagctctgctacctggtaatgaaggaatacacatcctgaagatctcgtgactatactggcatttcagatccaccccacccccagactcatcccactctctcccagcattttgtctgggaagagagactaccccatctttaccaccccctagaaatgagctgcaataacaggaacatgagacttcgcaaatctctggaaaataatatccaaatgaaattaagtctcactgaacatttcaatcaagaatggcagggatctattttattgaatattctagctactgtaacattgatatttatttttgtttgacat

SEQ ID NO: 18521 - DNA, 4465 bp, Homo sapiens
gggagctcagcggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacgggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaggccaggcccacagcctgaccagcctggccaagacctgggcagcaaggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtcaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccagggatctgccagcccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtttccaggc

SEQ ID NO: 18522 - DNA, 1476 bp, Homo sapiens
tgttttaagcagcttggcgagggcctacgggctctgcctcgatcagaactccacaaactgatcagccccttgcaatgtctgaaccacgtgtggaaactgcaccacccccaggacggaggccccctgcccctgcccacgcaccatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaggccaggcccacagcctgaccagcctggccaagacctgggcagcaaggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaaggtcggtgacggcacccagcatggccaacagggggagctgcagggccctggggcccaggctgcaggctggaggggctgctctgcggtggcagatggagcaaggggaggcctggtcatccatgtgggatcctaattcaaatacttgccacccaaatctgggggtacaaggggagatccagctgcggaggctcaccaagttcatggcaggtgagaactctcttctgtccataccctgggccccatccacctgcctcctaacgggccgggcctggaggctgtgggcgtcttgctgcctggctctggcctg

SEQ ID NO: 18523 - DNA, 4635 bp, Homo sapiens
atggagagcggcggtgggaatgctccggccggggccctcggggcggcgagcgagtcccctcagtgcccgccgccgccgggggtggagggcgcggccgggccggcggagcccgacggggcggcggagggcgcggcaggcggcagcggcgagggcgagagtgggggcgggccgcggcgggctctgcgggcagtatacgtgcgcagtgagagctcccagggcggcgcggccggcggcccggaggctggggcgcggcagtgcctgctgcgggcctgcgaggccgagggcgctcacctcacctccgtgcccttcggggagctggacttcggggagacggccgtgctcgacgccttctacgacgcagatgttgctgtggtagacatgagcgatgtctccagacagccttccctcttctaccatcttggagtccgagaaagctttgacatggccaataatgtgatcttgtaccatgacaccgatgccgacactgctctctctttgaaggacatggtaactcaaaaaaacacagcatccagtggaaattattatttcatcccatacatcgtgacaccgtgcgctgattatttttgctgcgagagtgatgcccagagacgagcctccgagtacatgcagcccaactgggacaacatcctgggcccgctgtgcatgcctttggtggacaggttcattagcctccttaaggacatccacgtgacctcatgtgtttattacaaagaaaccttgttaaatgacatccggaaagccagagagaaataccaaggtgaggaactggcgaaggagctagctcggatcaagctccgcatggataatactgaggttctgacctcagacatcatcattaacttactcctgtcctaccgtgatatccaggactatgatgcgatggtgaagctggtggaaacactggagatgctgcctacgtgtgatttggccgatcagcataacattaaattccactatgcgtttgcactgaataggagaaacagcacaggtgaccgtgagaaggctctgcagatcatgctccaggttctgcagagctgtgatcacccgggccccgacatgttctgcctgtgtgggaggatctacaaggacatcttcttggattcagactgcaaagatgacaccagccgcgacagcgccattgagtggtatcgcaaagggtttgaactccagtcatccctctattcgggaattaatcttgcagttttgctgattgttgctggacaacaatttgaaacttccttggaactaaggaaaataggtgtccggctgaacagtttgttgggaagaaaagggagcttggagaaaatgaacaattactgggatgtgggtcagttcttcagcgtcagcatgctggcccatgatgtcgggaaagccgtccaggcagcagagaggttgttcaaactgaaacctccagtctggtacctgcgatcattagttcagaacttgttactaattcggcgcttcaagaaaaccattattgaacactcgcccaggcaagagcggctgaacttctggttagatataatttttgaggcaacaaatgaagtcactaatggactcagatttccagttctggtcatagagccaaccaaagtgtaccagccttcttatgtttccataaacaatgaagccgaggagagaacagtttctttatggcatgtctcacccacagaaatgaaacagatgcacgaatggaattttacagcctcttccataaagggaataagcctatcaaagtttgatgaaaggtgttgttttctttatgtccatgataattctgatgactttcaaatctacttttccaccgaagagcagtgcagtagatttttctctttggtcaaagagatgataaccaatacagcaggcagtacggtggagctggagggagagaccgatggagacaccttggagtatgagtatgaccatgatgcaaatggtgagagagttgtcttggggaaaggcacgtatgggattgtgtatgctggccgagatctgagcaatcaagtgcgaatagccatcaaagaaatcccggagagagatagcaggtattctcagcctctgcacgaggagatagccctgcacaagtaccttaagcaccgcaatatcgttcagtacctgggctctgtttcagagaacggctacattaagatatttatggagcaggtgcctggaggaagcctttctgctcttctgcgatccaaatgggggccgatgaaggaaccgacaatcaagttttacaccaaacagatcctggagggccttaagtatcttcatgaaaaccagatcgtgcacagagacataaagggcgataatgttctggtgaacacctacagcggagtggtgaaaatctccgattttggaacctcgaaacgtcttgcgggtgtgaacccctgcacagagacttttactggcaccctgcagtacatggcacctgagataattgaccaagggcctcgcggatatggtgccccagccgatatctggtccctgggctgcaccatcattgagatggccaccagcaagcctccgttccatgagcttggtgagccgcaggcagccatgttcaaagtgggcatgtttaagatccaccctgagattccagaagccctttcagctgaagcccgagccttcattttatcctgtttcgagcctgacccccacaaacgtgccaccactgctgagctactgagagagggtttcttaaggcaggtgaacaagggcaagaagaaccgaattgccttcaagccctcagaaggtccccgcggtgtcgtcctggccctgcccacacagggagagcccatggccaccagcagcagcgagcacggctctgtctccccagactccgacgcccagcctgacgcactctttgagaggacccgggcgcccaggcaccaccttggccacctcctcagtgttccagacgagagctcagccttggaagaccggggcttggcctcgtccccggaggacagggaccagggcctcttcctgctacgcaaggacagtgagcgccgtgccatcctgtacaaaatcctctgggaggagcagaaccaggtggcttccaacctgcaggagtgtgtggcccagagttccgaagagttgcatctctcagttggacacatcaagcaaatcattgggatcctgagggacttcatccgctccccagagcaccgggtgatggcgaccacaatatcaaagctcaaggtggacctggactttgacagctcgtccatcagtcagattcacctggtgctgttcggatttcaggatgccgtaaataaaattttgaggaaccacttaattaggccccactggatgttcgcgatggacaacatcatccgccgagcggtgcaggccgcggtcaccattctcatcccagagctccgagcccactttgagcctacctgtgagactgaaggggtagataaggacatggatgaagcggaagagggctatcccccagccaccggacctggccaggaggcccagccccaccagcagcacctgagcctccagctgggtgagctcagacaggagaccaacagacttttggaacacctagttgaaaaagagagagagtaccagaatcttctgcggcaaactctagaacagaaaactcaagaattgtatcaccttcagttaaaattaaaatcgaattgtattacagagaacccagcaggcccctacgggcagagaacagataaagagcttatagactggttgcggctgcaaggagctgatgcaaagacaattgaaaagattgttgaagagggttatacactttcggatattcttaatgagatcactaaggaagatctaagataccttcgactacggggtggtctcctctgcagactctggagtgcggtctcccagtacagaagggctcaggaggcctcagaaaccaaagacaaggcttgataccaatcagctaagctgtggcagagtgtcccaccacgctacatgttttgttaaagcttctgttagtgtatacacgaattccgctgtgtttacatatttaaaaatgccattgttcaattaatagtttaagaacttgttttaaatactgtcctgagtttcttttgaaacctgttatttataaacatagaactgtgtgtattgtgaaaacagtgagccttggttttgacctcccggaatattaggaaattcacttgtagtcccagctatgcaggaggctgaggtgggaggattgcttgagcccaggaggtgtggaggctgcagtgagccatgatcacaccactgcactccagcctgggcaacagagcccgaccctgtctcaaaaaaagtacacccttcagcacttgctggaatggtgaaacaaacaaggggtatttaacaaacatggaagctgggacactgcctcagaactggtatggtacttcaatttgagaaacacaaaactgatacgaatgtgccttgtagttaatgtttgatatgaacagaaaatagcttcatatttatactgaatgtgtaagtagagaaaactaagttatgtggcctttgaaatgattacaaaattggaatgattacaaaagtcttattttaaaatggaactgtcctcttgcctgataataaatattgtatcttgtagag

SEQ ID NO: 18524 - DNA, 5397 bp, Homo sapiens
gatctgggaggcttgtccctcgccgcccaccgtagccccggcgctcggccggtcgccgtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcgtaaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcgtcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaagctca

SEQ ID NO: 18525 - DNA, 5490 bp, Homo sapiens
gtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcgtaaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcagcactcggagcatgccttccgacgcgcggagccatggcagccctgctgctgctgctgctgctgctgctgctgctgttgctgccagtcggcccagcccctctggtggtgactctgtgctgcccaaatccatcagcagtgcccatgataccaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcgtcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaagctca

SEQ ID NO: 18526 - DNA, 4636 bp, Homo sapiens
aagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcgtaaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagatctgcaaagatacagag

SEQ ID NO: 18527 - DNA, 461 bp, Homo sapiens
acttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaaggtgtccgtcagatctcccatgctgtttcttcctccttaaattga

SEQ ID NO: 18528 - DNA, 2999 bp, Homo sapiens
ggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaat

SEQ ID NO: 18529 - DNA, 5197 bp, Homo sapiens
cgagcgcggcgcccttgagctgcaccgcggcgcaggtttgcgagccgacttgtcagccggccaagaaaaggaagctccgtcccttcccgctcacccggcttccccaccccttgtactctaaactctgcagagggcgagcggcgcggccacggaggcgccgaggaggagcgagccgccgccgggcagcggcgtgccctcgggggagagggcgccggagaggaggcggcggcgcggcggcgagggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacgagggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacata

SEQ ID NO: 18530 - DNA, 3889 bp, Homo sapiens
cgagcgcggcgcccttgagctgcaccgcggcgcaggtttgcgagccgacttgtcagccggccaagaaaaggaagctccgtcccttcccgctcacccggcttccccaccccttgtactctaaactctgcagagggcgagcggcgcggccacggaggcgccgaggaggagcgagccgccgccgggcagcggcgtgccctcgggggagagggcgccggagaggaggcggcggcgcggcggcgagggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacgagggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagatctgtccatagcacaagcagaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccaggaataaagccc

SEQ ID NO: 18531 - DNA, 4136 bp, Homo sapiens
tgagctgccgatcaccggatgccccagattcctgggacccaatcccggatttcagaacctcaggaccttgcaagtccgagctaggatttctccctggactttagattcctggaacgggacgtcaggccgtattccggatccctagatcccgtgggagattctccgattccgaacggattccagatcccaagattcctgatctgccggcccaggctcctgccccgcccccggttcccagtgcgcggcgccccgcgcctgagcgcccccgcatggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggaggatgttttccagaagaactcggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctga

SEQ ID NO: 18532 - DNA, 1496 bp, Homo sapiens
cgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccag

SEQ ID NO: 18533 - DNA, 4304 bp, Homo sapiens
gccccagattcctgggacccaatcccggatttcagaacctcaggaccttgcaagtccgagctaggatttctccctggactttagattcctggaacgggacgtcaggccgtattccggatccctagatcccgtgggagattctccgattccgaacggattccagatcccaagattcctgatctgccggcccaggctcctgccccgcccccggttcccagtgcgcggcgccccgcgcctgagcgcccccgcatggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaaccttt

SEQ ID NO: 18534 - DNA, 2530 bp, Homo sapiens
tcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaa

SEQ ID NO: 18535 - DNA, 444 bp, Homo sapiens
gggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaa

SEQ ID NO: 18536 - DNA, 4309 bp, Homo sapiens
gattcccaggatcccccaagtggctctgagctgccgatcaccggatgccccagattcctgggacccaatcccggatttcagaacctcaggaccttgcaagtccgagctaggatttctccctggactttagattcctggaacgggacgtcaggccatcccaagattcctgatctgccggcccaggctcctgccccgcccccggttcccagtgcgcggcgccccgcgcctgagcgcccccgcatggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggaggatgttttccagaagaactcggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacactt

SEQ ID NO: 18537 - DNA, 3474 bp, Homo sapiens
gccccagattcctgggacccaatcccggatttcagaacctcaggaccttgcaagtccgagctaggatttctccctggactttagattcctggaacgggacgtcaggccgtattccggatccctagatcccgtgggagattctccgattccgaacggattccagatcccaagattcctgatctgccggcccaggctcctgccccgcccccggttcccagtgcgcggcgccccgcgcctgagcgcccccgcatggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggaggatgttttccagaagaactcggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggatggatgaatggagaggacaaaggcagcttctga

SEQ ID NO: 18538 - DNA, 3328 bp, Homo sapiens
cataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaa

SEQ ID NO: 18539 - DNA, 4633 bp, Homo sapiens
atgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacggatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggta

SEQ ID NO: 18540 - DNA, 4558 bp, Homo sapiens
gggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacggatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggta

SEQ ID NO: 18541 - DNA, 4911 bp, Homo sapiens
ggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacggatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggta

SEQ ID NO: 18542 - DNA, 4830 bp, Homo sapiens
ggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacggatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggta

SEQ ID NO: 18543 - DNA, 1773 bp, Homo sapiens
aaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttac

SEQ ID NO: 18544 - DNA, 3096 bp, Homo sapiens
cgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccgtgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgcctt

SEQ ID NO: 18545 - DNA, 2518 bp, Homo sapiens
aaatcctgttgccaatccttgtatgtcagtttcccatgggtcttgaatgcaaatacaaatatcgtaaactaaatatttgtgttttctttcctagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccgtgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgcctta

SEQ ID NO: 18546 - DNA, 893 bp, Homo sapiens
cttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtacgtttctttccgatcagttgggtgctatgtgctcagctttcctactgcagcttcatttaatgcagagtggtgtttgaatttggcttagatgggctggcaggcatgattttaaaaaatgtaatcatcagtaagaagtacttccatgttaaagatgcaaaaaaaaaa

SEQ ID NO: 18547 - DNA, 3090 bp, Homo sapiens
cgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccaccactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccgtgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgcctta

SEQ ID NO: 18548 - DNA, 776 bp, Homo sapiens
cgcggggaagcggggacccgctgtcactgcgcctcccgctgccgacgccgcctggacggccgcactctccctgcccgagacccgactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtgga

SEQ ID NO: 18549 - DNA, 1026 bp, Homo sapiens
gggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaa

SEQ ID NO: 18550 - DNA, 647 bp, Homo sapiens
ctgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacgtaagtatctttggacatatacctttttggctcaaagagactagttattcaggagacaaacaagctccttcctgtaatctgaagaccctccatggagggtggaaagctccctcagagca

SEQ ID NO: 18551 - DNA, 1682 bp, Homo sapiens
cagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctga

SEQ ID NO: 18552 - DNA, 5602 bp, Homo sapiens
atggagccctccagagcgcttctcggctgcctagcgagcgccgccgctgccgccccgccgggggaggatggagcaggggccggggccgaggaggaggaggaggaggaggaggaggcggcggcggcggtgggccccggggagctgggctgcgacgcgccgctgccctactggacggccgtgttcgagtacgaggcggcgggcgaggacgagctgaccctgcggctgggcgacgtggtggaggtgctgtccaaggactcgcaggtgtccggcgacgagggctggtggaccgggcagctgaaccagcgggtgggcatcttccccagcaactacgtgaccccgcgcagcgccttctccagccgctgccagcccggcggcgaggaccccagttgctacccgcccattcagttgttagaaattgattttgcggagctcaccttggaagagattattggcatcgggggctttgggaaggtctatcgtgctttctggataggggatgaggttgctgtgaaagcagctcgccacgaccctgatgaggacatcagccagaccatagagaatgttcgccaagaggccaagctcttcgccatgctgaagcaccccaacatcattgccctaagaggggtatgtctgaaggagcccaacctctgcttggtcatggagtttgctcgtggaggacctttgaatagagtgttatctgggaaaaggattcccccagacatcctggtgaattgggctgtgcagattgccagagggatgaactacttacatgatgaggcaattgttcccatcatccaccgcgaccttaagtccagcaacatattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagttgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaaggatcccctcagagacgtgagaaagctaatggtttaagtaccccatcagaatctccacatttccacttgggcctcaagtccctggtagatggatataagcagtggtcgtccagtgcccccaacctggtgaagggcccaaggagtagcccggccctgccagggttcaccagccttatggagatggccttgctggcagccagttgggtggtgcccatcgacattgaagaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattctgtgattgattttggtcctcctccgctgtcccccaacacccaggaatgggaatctggcttggttcgagataggagcttttctgtgtcctaagccctttcatgctagcaggaagactgaaagcaaggtggcccagtgtggggtcatagggcttgatagacctggcactgcctatctgcacttccaggtgccccacctatttatctgagcccacaggtggaaaggggaactgcctcagtgagaacggggggacggggatgttaggaaaaatacagtaaagttgcaatgaagaggttcatgaagtatgtccttgttctttttggaaactctcggcaaagggcaaaccagcaagtattgagggtacccatctagctacttggggtcaggacctcgtcagaccaggttcggatacaatcatctgctcatcccaggaatagtttcttgggggactcactcactggtgccagttctaagtcagagacaaaattccactgtctgttccttttgctgtctgaactttatgtgttactcccttcctttggtcttcactctaatccctggagtttgtgggcttttggttatgtttggttagtagatatcaccgcaatgccctagaacagctatgaagcagaataccatatggccacctggacattgggacttgggaattcactctcaactgggccatccatgttgtgatgcccttgaagtaaaatggagccagcaggagtaccttctgtaaatgcatgtggcaaagtgctatttatagggtgcccagggagccgctgatgtacaataaccttgaggtcccccatactgaaaactgaccaaggcctgtgcacaggtagcccctcatgctgggctctggaccatgagctgagtaggaaggatagcagaggccaaccctgaccttcctggaagttgtttccttaacttgaatgttgagcttcctctaaagctttctcgtgtatgtcttctccatgccactactctgaggcctcctgtgttatgtgtgaacagttgtctttatgtgggaatgacgacttgattgggagtagagtctcaaggtcattcccctcttccctcaagactctctgaatgctgctccactgtcttttgtcttggaggtcactcagcaggttccttgcatttgctgcctggatgtgcagctggcaacagtgatgaattggtcactgctctttctctataactgggatagatgtcctgccttggggtcactaaaggggtgaccttgttccttgctttatgagcccattagcactttggttcaaggggcccaccaagtcttggacgggaaggcgctactggttttattgcccaaggttttgttattgcttctcttctgtgtccttctctttgttcagtgaagccaatatgtaagatactgtttttgtccccattcccctactcctgagctaggaggaaaaaatgtgaatcttaccagcagttccagccaaccaagtgattcttcttcattcttgatggggagaagtacatacaaagtttgttctgacagggcgcggtggctcacgcctgtaatcccagcgctttgggaggcagaggcaggtggatcacctgaggtcgggagttcgagaccagcctgaccaacatggagatatcctgtctctactaaaaatacaaaaaaattagccaggcatggtggcacgtgcctgtaatcccagctactcgcaaggctgaggcaggagaatcgcttgaacctgggaggcggaggttgcagtgagccaagattgcgccattgcactccagcctgggcaacaagagagaaactctgtctcaaaa

SEQ ID NO: 18553 - DNA, 2708 bp, Homo sapiens
ctagtattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagttgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaaggcctcaagtccctggtagatggatataagcagtggtcgtccagtgcccccaacctggtgaagggcccaaggagtagcccggccctgccagggttcaccagccttatggagatggcctgtttctcttccactcttgtcatcttcacagaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaag

SEQ ID NO: 18554 - DNA, 5581 bp, Homo sapiens
atggagccctccagagcgcttctcggctgcctagcgagcgccgccgctgccgccccgccgggggaggatggagcaggggccggggccgaggaggaggaggaggaggaggaggaggcggcggcggcggtgggccccggggagctgggctgcgacgcgccgctgccctactggacggccgtgttcgagtacgaggcggcgggcgaggacgagctgaccctgcggctgggcgacgtggtggaggtgctgtccaaggactcgcaggtgtccggcgacgagggctggtggaccgggcagctgaaccagcgggtgggcatcttccccagcaactacgtgaccccgcgcagcgccttctccagccgctgccagcccggcggcgaggaccccagttgctacccgcccattcagttgttagaaattgattttgcggagctcaccttggaagagattattggcatcgggggctttgggaaggtctatcgtgctttctggataggggatgaggttgctgtgaaagcagctcgccacgaccctgatgaggacatcagccagaccatagagaatgttcgccaagaggccaagctcttcgccatgctgaagcaccccaacatcattgccctaagaggggtatgtctgaaggagcccaacctctgcttggtcatggagtttgctcgtggaggacctttgaatagagtgttatctgggaaaaggattcccccagacatcctggtgaattgggctgtgcagattgccagagggatgaactacttacatgatgaggcaattgttcccatcatccaccgcgaccttaagtccagcaacatattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagttgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaaggatcccctcagagacgtgagaaagctaatggtttaagtaccccatcagaatctccacatttccacttgggcctcaagtccctggtagatggatataagcagtggtcgtccagtgcccccaacctggtgaagggcccaaggagtagcccggccctgccagggttcaccagccttatggagatggaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattctgtgattgattttggtcctcctccgctgtcccccaacacccaggaatgggaatctggcttggttcgagataggagcttttctgtgtcctaagccctttcatgctagcaggaagactgaaagcaaggtggcccagtgtggggtcatagggcttgatagacctggcactgcctatctgcacttccaggtgccccacctatttatctgagcccacaggtggaaaggggaactgcctcagtgagaacggggggacggggatgttaggaaaaatacagtaaagttgcaatgaagaggttcatgaagtatgtccttgttctttttggaaactctcggcaaagggcaaaccagcaagtattgagggtacccatctagctacttggggtcaggacctcgtcagaccaggttcggatacaatcatctgctcatcccaggaatagtttcttgggggactcactcactggtgccagttctaagtcagagacaaaattccactgtctgttccttttgctgtctgaactttatgtgttactcccttcctttggtcttcactctaatccctggagtttgtgggcttttggttatgtttggttagtagatatcaccgcaatgccctagaacagctatgaagcagaataccatatggccacctggacattgggacttgggaattcactctcaactgggccatccatgttgtgatgcccttgaagtaaaatggagccagcaggagtaccttctgtaaatgcatgtggcaaagtgctatttatagggtgcccagggagccgctgatgtacaataaccttgaggtcccccatactgaaaactgaccaaggcctgtgcacaggtagcccctcatgctgggctctggaccatgagctgagtaggaaggatagcagaggccaaccctgaccttcctggaagttgtttccttaacttgaatgttgagcttcctctaaagctttctcgtgtatgtcttctccatgccactactctgaggcctcctgtgttatgtgtgaacagttgtctttatgtgggaatgacgacttgattgggagtagagtctcaaggtcattcccctcttccctcaagactctctgaatgctgctccactgtcttttgtcttggaggtcactcagcaggttccttgcatttgctgcctggatgtgcagctggcaacagtgatgaattggtcactgctctttctctataactgggatagatgtcctgccttggggtcactaaaggggtgaccttgttccttgctttatgagcccattagcactttggttcaaggggcccaccaagtcttggacgggaaggcgctactggttttattgcccaaggttttgttattgcttctcttctgtgtccttctctttgttcagtgaagccaatatgtaagatactgtttttgtccccattcccctactcctgagctaggaggaaaaaatgtgaatcttaccagcagttccagccaaccaagtgattcttcttcattcttgatggggagaagtacatacaaagtttgttctgacagggcgcggtggctcacgcctgtaatcccagcgctttgggaggcagaggcaggtggatcacctgaggtcgggagttcgagaccagcctgaccaacatggagatatcctgtctctactaaaaatacaaaaaaattagccaggcatggtggcacgtgcctgtaatcccagctactcgcaaggctgaggcaggagaatcgcttgaacctgggaggcggaggttgcagtgagccaagattgcgccattgcactccagcctgggcaacaagagagaaactctgtctcaaaaaaaaaaaaaaaaaaaaaaaaa

SEQ ID NO: 18555 - DNA, 2607 bp, Homo sapiens
gcggaggcaaggcgggtgcagggcttctggggacggagggaggtgccagaagttgagccctgaggccctgctggcccctgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggctggagtgcagtggcacgatctcgcctcactgcaacctcctcctcccaggttcaagcaattctcctgcctcagcctcccgagtagctgggattacaggtttg

SEQ ID NO: 18556 - DNA, 2681 bp, Homo sapiens
gcggaggcaaggcgggtgcagggcttctggggacggagggaggtgccagaagttgagccctgaggccctgctggcccctgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgc

SEQ ID NO: 18557 - DNA, 1225 bp, Homo sapiens
tggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatggaaagaccccccacctgtattctcatagcatccttggcctgctggaacggaaagagaccagagcaggaaaccccatcgctcacattagcccccaccgcctactggcaaggtaccagctcccaatgaatggcaccacacagccttataattcctcccatgcccctctgcctcctgctgtcctaccccccttcacacctacctattctccaggaagaacatggtttccaccaagatccaggacaccaaa

SEQ ID NO: 18558 - DNA, 2700 bp, Homo sapiens
gggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggctggagtgcagtggcacgatctcgcctcactgcaacctcctcctcccaggttcaagcaattctcctgcctcagcctcccgagtagctgggattacaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgc

SEQ ID NO: 18559 - DNA, 2955 bp, Homo sapiens
cagagccacgggcgcccgccccgccccgcgccgccccgcgccggctccgcagctcgcgcccgcccgcctgccggcccgcccggcgccgggccatggcgctgctgcgggatgtgtcgctgcaggacccgcgggaccgcttcgagctgctgcagcgcgtgggggccgggacctatggcgacgtctacaaggcccgcgacacggtcacgtccgaactggccgccgtgaagatagtcaagctagacccaggggacgacatcagctccctccagcaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagaggcactgaaggggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 18560 - DNA, 4354 bp, Homo sapiens
gggtggggaacgtggtgcggcggcggcggcggcggcgactgtacgcgcctccgccgcccccgagaggacgcgccgtgcagcggctgagtggcggcggcggcgacggcaaacccggagctgccggccggcgcgcgggaggaggacgcgggtgcggtctaggaagtaggtcccgggctccgcgctcaacaaagacggggccgcccccattagacggagctgcgggcggaggctccatgttgggaagcggcgccgttcgtgcttgttagcgggaatccgggagccgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggccagaaatgtacacacaggagagctggctgcagtaaaaatcattaaattggagcctggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcattggcaccccttactggatggccccagaagttgcagcagtagagaagaatggtggctacaaccaactctgtgatatctgggcagtaggaataacagcaattgaacttggagaacttcagccacctatgtttgatctccacccaatgagggctctcttcttaatgtcaaaaagtaattttcagcctccaaaactaaaggacaaaacaaaatggtcatcaacattccataattttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggaaatggtgatggtatttcaaaactgatgagtgaaaatacagaaggatcagcacaagcaccacagttaccacgaaaaaaggacaaacgagacttccctaaaccagccatcaatggccttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcagtaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtatgagccaatgcagaaattcatgttgataaagcactttgattttcctttgccaagtcctttgaatgtttttgaaatgctggtgatacctgaacaggaataccctatggtctgtgtagctattagcaaaggcactgaatcgaatcaggtagttcagtttgagacaatcaatttgaactctgcatcttcatggtttacagaaattggtgcaggcagccagcagttagattccattcatgtaacacagttggagagagataccgttttagtgtgtttagacaaatttgtgaaaattgtaaatctacaaggaaaattaaaatcaagtaagaaactggcctctgagttaagttttgattttcgcattgaatctgtagtatgccttcaagacagtgtgttggctttctggaaacatgggatgcagggtaaaagcttcaagtcagatgaggttacccaggagatttcagatgaaacaagagttttccgcttattaggatcagacagggttgtcgttttggaaagtaggccaacagaaaatcctactgcacacagcaatctctacatcttggctggacatgaaaatagttactaagcaacagaaactgatctcaaatgacaggaaaatgaatatactccattgaaaggaaaaataaggaaattcaatacaaactgcactatgatttgctttaactattatgggttatattgcaaatgatctgtactttagggtagaattcaatattttctgcagctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaat

SEQ ID NO: 18561 - DNA, 1971 bp, Homo sapiens
atggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgccggacccggtaccccgacatccacttgcgcgagcgcctggccgcgctcaccctgctccccgagtccaggatccaggtatggttccagaacaggcgtgccaagtctcggcgtcagagtgggaaatccttccaacctttggctaggccggagattatcctcaaccactgtgctcctggaactgaaacgaaatgtctgaagccccagctgcctcttgaggtagatgtgaactgcctgcccgaaccaaacggggttggagggggcatctctgactctagctcccaaggtcagaattttgaaacctgttcccctctctctgaagacattggttcaaagctggactcatgggaggaacacatcttttctgcctttggtaacttttgaggattctgggagaattcgggataagctctgaggagccatgactgacagcctgggagagacacatcagcatactgtcctttctgacttccatgctaaggacatgtccttgttaaccttgatgatggttttgacagcacctctcacatttgaaggtaccccgccactttgtcaatgacgttttaagcccacactcccaccccagagttcccgcattcgtttttacctgtgttctctccaagcctgcacattccattggtctgcatccctatgccttcttgccaggcctgtttttagtttttggactggttgttcagaactcattattttcttcacaagaatgcctcagcttgactcagtttccccttgtgtttgacagctgccattttctcctggtccctccaaggcttataatcttaaagtcactctaccccgtctcttcaaccctcatcctaggtttattactttttaaaattgggcctgtcatcttcacgttcaatcatagctccaatgactctgcatgcagattatttcgacagcccccttgcctctagcttctcaactacttaaaaaaaattaccctctgtgggccaggtgcagtggctcactcctgcaatctcagcactttgggaggccgagtgggtggatcacctgaagtcaggagttcaagaccagcctggccaatatggcgaaaccccatctctgctaaaaatataaaacttagctgggcacggtgacgggagcctgtagtcccagctactcaggaggctgaggcaggagaatcacttgagcctgggaggtggaggttgcagtgatctaagatcgtgccactgcacttcagcctgggagacagagggaggctctcaaaaaaaaaaaaaaaaaaaaaaaaaattactctatggttctgtggtagcctccagttgctaccaaattataaaaagctttcagttaccctcccagataactgatatcatccttagcctgcaggacagctatgcaaatctgaaggtcaactatccacaatatatgctttggtcttaaagtcactcctttcagttttgaaccaaattcataccttttgctttcaaaacactcgaggactccccacctgccttctgaagtctgaaattttctctaagtaatcctgattttgcacctgttacttcgatcactccattacccttagcacttgttattgtacttcctgtgcaagttttgtggattattaaatgtctttcacaaatgttccaatgtaatttctatttaaatgaattc

SEQ ID NO: 18562 - DNA, 839 bp, Homo sapiens
cctggcccgggagggtataagtgcggcccgcgcccctccgagcggcgcgctgggttccggagcgatggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgccggacccggtaccccgacatccacttgcgcgagcgcctggccgcgctcaccctgctccccgagtccaggatccagcttttattttctcccctcttccaggtatggttccagaacaggcgtgccaagtctcggcgtcagagtgggaaatccttccaacctttggctaggccggagattatcctcaaccactgtgctcctggaactgaaacgaaatgtctgaagccccagctgcctcttgaggtagatgtgaactgcctgcccgaaccaaacggggttggagggggcatctctgactctagctcccaaggtcagaattttgaaacctgttcccctctctctgaagacattggttcaaagctggactcatgggaggaacacatcttttctgcctttggtaacttttgaggattctgggagaattcgggataagctctgaggagccatgactgacagcctg

SEQ ID NO: 18563 - DNA, 1734 bp, Homo sapiens
acttccgcctcgggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtaggacttgggagtcattgggaaaaaaaaataataaattttccccttcattaacgaattcagactcattaaaaacattgccatcaga

SEQ ID NO: 18564 - DNA, 1998 bp, Homo sapiens
cggattggctgttcggagcggcgaggggcttggcgggagcttccagtcgctcgagagcggagagcggcaccatggccccgcgggggcggcggcggccgcggcctcacaggtctgagggcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcaga

SEQ ID NO: 18565 - DNA, 1549 bp, Homo sapiens
attggctgttcggagcggcgaggggcttggcgggagcttccagtcgctcgagagcggagagcggcaccatggccccgcgggggcggcggcggccgcggcctcacaggtctgagggcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaa

SEQ ID NO: 18566 - DNA, 1547 bp, Homo sapiens
attggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaatt

SEQ ID NO: 18567 - DNA, 1014 bp, Homo sapiens
atggccccgcgggggcggcggcggccgcggcctcacaggtctgagggcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcgtctctggacaggtgctggcctatggtaa

SEQ ID NO: 18568 - DNA, 5799 bp, Homo sapiens
cctccccctcccgccgcgccgcgcgctcgcggacagtcggcgcgcgggccgggccgggccggcgcccctctgcctcgcgcgcttgtcgcgttgccccgggctccgggggatgcccccggccgagcccttctcatggccgccgacgtcttcatgtgctccccgcgccggcctcgcagccggggccgccaggtgctgctcaagccccaggtgtccgaggacgacgacgactcggacacggatgagccgtccccgccgcccgcctccggcgcggccaccccggcccgggcccacgcgagcgccgcgccaccgccgcctcgggccgggccgggccgcgaggaacctccgcgccgccagcagatcatccacagcggccacttcatggtgtcgtcgccgcaccgagagcacccgcccaagaagggctacgatttcgacacggtcaacaaacagacgtgccagacctacagcttcggcaagactagctcctgccacctgtccatcgacgcctcgctcaccaagctcttcgagtgcatgactttggcctacagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaaaaaaaaaaaaaatttagccgtgtgtagcagtgagtgcctgtggtcccagctacttgggcctgaggctggaggattgcttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtcta

SEQ ID NO: 18569 - DNA, 657 bp, Homo sapiens
atggatgagcagggctgtgaacacacctcccggactgaggacccgtttatccagcccacggacttcggtccctcagagccgccactgagtgtcccgccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccaggtgagccaggcggggagactcagtgcggggctccccccgacccagagggatgttttcccatcccaaaggctttcaaacttgtgaccaccaccaccaccctggtgtgcacgtgcatgcgcacacacatacacttaaatgaaacaaaagtgtcatga

SEQ ID NO: 18570 - DNA, 5097 bp, Homo sapiens
gtgcagaggcacgattccatccctcttttacagcatccttcagcacccatggggtgggagactcttggtccaggtgtgcttctgcctgagtgccaggtaacctatgtgcagctagctctgctccgactaattaacacagaattagctagacagagaagaaaaacatggattactaataaaaataacttctgtatatttctttcacgttttactaagcaatccaaaaagttgcttacaggtgcttggggctacagagctgagtgaggtaccattctttgtccttacggagccctcatgcttatgcccatgaccagttagacactggtaacctggcaccatcttcaaacgggctccgggaagaattgctactgcagagactgggatctgaaccattgattcctcgtagcttttcttatttaggaagaggtggcctgatgaccagttgacacgtgaaattgtcctcggggattcccgagcagctgcaatccaggctgcctctgctcagtaatagaagatggcagagactttggggagactctgctggactccagaaacaagatattcccaggctgctagccagctgtgtgagggccgttgccttatctgagctctgagttatttagtttttaatggaaacaagacccccgcagacacgcagggaaacacaaatccctatcagatcagcagccatggacgtggagacgtggcctttgtccctctgtcccagcgcccggcctgtgtagttggacttggcagtgtgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctac

SEQ ID NO: 18571 - DNA, 3278 bp, Homo sapiens
ccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggtt

SEQ ID NO: 18572 - DNA, 3215 bp, Homo sapiens
ccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaaccggcgtatcacacacatctccgcggagcagaagcggcgcttcaacatcaagctggggtttgacacccttcatgggctcgtgagcacactcagtgcccagcccagcctcaaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggtt

SEQ ID NO: 18573 - DNA, 2999 bp, Homo sapiens
ccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggtt

SEQ ID NO: 18574 - DNA, 3224 bp, Homo sapiens
atggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggtt

SEQ ID NO: 18575 - DNA, 3173 bp, Homo sapiens
atggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggtt

SEQ ID NO: 18576 - DNA, 3847 bp, Homo sapiens
gactcggcgggcccggggctccccggcagcggctcctctgctaggggttaacagcagcccccgcggccgggcgggcgcggacgcttcctctccacccgcccgggaacgtggataccgcgcccgcaggatgttcgccggctgggaccggcagtcaggaaacatgagaaggcctcgctattcctgttcccgggcggcgcgcgccgggctgggtaaataaagccgagacgacggcggtggcggtggtgagcgcgctggagcccgcgtggagaacatgcggcggggatgggagtgcgcctagtctcgaggcgggagagccagccgccctgcagccggccgtcggccccgcagccacagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccggcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtgtcaaattggtttgctaatgcaagacgtcggcttaagaataccgttcgacagccagatttaagctgggctttgagaataaagttatacaacaagtatgttcaaggcaatgctgaacggcttagcgtaagcagtgatgactcatgttctgaagatggagaaaatcctccaagaacccacatgaacgaagggggctataataccccagttcaccatcctgtgattaaaagtgagaattcggtcatcaaagcgggagtgaggccagagtcacgggccagtgaggactacgtggcaccccccaaatacaagagcagcttgttgaaccgttaccttaatgactctttgagacatgtcatggccacgaacactaccatgatgggaaaaacaaggcaaagaaaccactcgggatcttttagctccaatgaatttgaggaagaattagtgtctccatcgtcatcagaaactgaaggcaactttgtctatcgcacagacactctggaaaacggatccaataagggtgaaagcgcagctaacagaaaaggaccaagcaaggatgacacgtattggaaggagatcaacgcagctatggccttaacaaatcttgcacagggaaaggacaaactgcagggaactaccagctgcatcatccagaagtcgtcccatatagcagaagtaaagactgtcaaagtgccgctggtgcagcagttttaagagcttgttgcttttcagatccaatggatgttctttccggtgttttcatcaaccctcatcctaagagccgaagcagggatgaaaatgactctctcccaaacctcttcttatttttaattatcccaaatatatcatttagttgcttctataaaagacatataaattataaaaaactcattttaatcaaaaatattaacttattttatgttactcaaactatgcataaaacatctgcattaccattacagtaagtgccttgcttcccgacaataagctccaacgtgggcatagttgaacaagctatgcctcaaaatgccaacgccatatgcttattagcctgtgtgcatcattccagacgggcctaatcattccaggactgaaaccagaatcgctgaaagcccttgaaatacattcaataattcatatgttaaaacttggatatctgttcagcccaaatgaaatcttccttttaaaaaacgtctacattattgaaaattgttcaatgtgcttttcagagtgacggtgagaattttatgcatgtatcttgcctgcatatttgatatgttacaaacttccaaaattcaaggtgcagcgatccacagaacgttgtacatttaagaagtgattccttcaagctaatttaaaatttcattgaacacatggtgaccaggaaaactttttttcaagcactgttggaaagcaccacaaagccctttagaattaatctggatttgtttctcaagttctgctgaagtttaaaaaaaaactttattatacaaataactcaaaattttcctgtgtaaaactaaacctgtagttttaaaacataatcctgtttgcattagagctcactgtctttttgtgatggaaactgtgttcgtatggaatgactaaaaatcttttatttggtttgtttcaaattacaattgctgatggacaatttgtattgcagcgagaacaacagaatgaaagaaatgtatctctgtgcggctatacatatacatacataaaattgatttttaaatttaaaacatatggaaaacaaaacattgaacagtttgaattttgccaagttggacattaaagtaaaaatgaagtgaaatcatgcattgaaagaaaacattttgtttctaaattagtctaccattgagtgagaataatcaatatcaagaaagaagactatctttctcaactaaacaataatattccaatcagcttgggaagacctgaaacttgaataagcagtggaaatgccaaatataacagagggtatgtgctacagagaagtaaaaagggtttgactttttatgatgggattttttttttctgggtatgtaatctattttttttttaaactggaaagcatttttgtcagtgtgaatgagggtcaatagtgcagccagtggtgacatttttctttattttgcaaaatgcttttaaaaccaaaggctgctctagttgatggacagtatcagtcttgatctaaattgtaggacactttttcatgtaacataacatttggggattgggtttatttagtgtaatgaagataatttgatataaaaatattttgtgtatatatatatatttttactttgttttctaaattgctgtttgcagtaacagtaagcgcaaagcaaaatatataagttatgactgtatgatcagatgaagtatgagttcttttggtttgcatccttaaatagttagagatctctgataaaaactttggaatctttgcaaaacaatacaaaaatgccaaaatgtgagcatgtcaatgaaaactaaagacaaatacttcactctttttcatactattataagttattctggtattaaatatgttaataaaagtgtttttgttttgacatatttcagttaaatgaatgaatgctggttgtattttatttgaatgagtcatgattcatgtttgccatctttttaaaaaaatcagcaaatttcttctatgttataaattatagatgacaaggcaatataggacaactattcacatgattttttttaataccaaaggttggaagattttataattaacatgtcaagaagactttatagtaagcacatccttggtaatatctccaattgcaatgactttttaatttattttttcttttgctgctttaacattttctggatattaaaatccccccagtcctttaaaagaatcttgaacaatgctgagccggcagctgaaaatctaactcataatttatgttgtagagaaatagaattacctctattctttgttttgccatatgtaatcattttaataaaattaataactgccaggagttcttgacagatttaaaataaaagttaatttctagacctcga

SEQ ID NO: 18577 - DNA, 3638 bp, Homo sapiens
aaataaagccgagacgacggcggtggcggtggtgagcgcgctggagcccgcgtggagaacatgcggcggggatgggagtgcgcctagtctcgaggcgggagagccagccgccctgcagccggccgtcggccccgcagccacagaagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccggcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtgtcaaattggtttgctaatgcaagacgtcggcttaagaataccgttcgacagccagatttaagctgggctttgagaataaagttatacaacaagtatgttcaaggcaatgctgaacggcttagcgtaagcagtgatgactcatgttctgaagatggagaaaatcctccaagaacccacatgaacgaagggggctataataccccagttcaccatcctgtgattaaaagtgagaattcggtcatcaaagcgggagtgaggccagagtcacgggccagtgaggactacgtggcaccccccaaatacaagagcagcttgttgaaccgttaccttaatgactctttgagacatgtcatggccacgaacactaccatgatgggaaaaacaaggcaaagaaaccactcgggatcttttagctccaatgaatttgaggaagaattagtgtctccatcgtcatcagaaactgaaggcaactttgtctatcgcacagacactctggaaaacggatccaataagggtgaaagcgcagctaacagaaaaggaccaagcaaggatgacacgtattggaaggagatcaacgcagctatggccttaacaaatcttgcacagggaaaggacaaactgcagggaactaccagctgcatcatccagaagtcgtcccatatagcagaagtaaagactgtcaaagtgccgctggtgcagcagttttaagagcttgttgcttttcagatccaatggatgttctttccggtgttttcatcaaccctcatcctaagagccgaagcagggatgaaaatgactctctcccaaacctcttcttatttttaattatcccaaatatatcatttagttgcttctataaaagacatataaattataaaaaactcattttaatcaaaaatattaacttattttatgttactcaaactatgcataaaacatctgcattaccattacagtaagtgccttgcttcccgacaataagctccaacgtgggcatagttgaacaagctatgcctcaaaatgccaacgccatatgcttattagcctgtgtgcatcattccagacgggcctaatcattccaggactgaaaccagaatcgctgaaagcccttgaaatacattcaataattcatatgttaaaacttggatatctgttcagcccaaatgaaatcttccttttaaaaaacgtctacattattgaaaattgttcaatgtgcttttcagagtgacggtgagaattttatgcatgtatcttgcctgcatatttgatatgttacaaacttccaaaattcaaggtgcagcgatccacagaacgttgtacatttaagaagtgattccttcaagctaatttaaaatttcattgaacacatggtgaccaggaaaactttttttcaagcactgttggaaagcaccacaaagccctttagaattaatctggatttgtttctcaagttctgctgaagtttaaaaaaaaactttattatacaaataactcaaaattttcctgtgtaaaactaaacctgtagttttaaaacataatcctgtttgcattagagctcactgtctttttgtgatggaaactgtgttcgtatggaatgactaaaaatcttttatttggtttgtttcaaattacaattgctgatggacaatttgtattgcagcgagaacaacagaatgaaagaaatgtatctctgtgcggctatacatatacatacataaaattgatttttaaatttaaaacatatggaaaacaaaacattgaacagtttgaattttgccaagttggacattaaagtaaaaatgaagtgaaatcatgcattgaaagaaaacattttgtttctaaattagtctaccattgagtgagaataatcaatatcaagaaagaagactatctttctcaactaaacaataatattccaatcagcttgggaagacctgaaacttgaataagcagtggaaatgccaaatataacagagggtatgtgctacagagaagtaaaaagggtttgactttttatgatgggattttttttttctgggtatgtaatctattttttttttaaactggaaagcatttttgtcagtgtgaatgagggtcaatagtgcagccagtggtgacatttttctttattttgcaaaatgcttttaaaaccaaaggctgctctagttgatggacagtatcagtcttgatctaaattgtaggacactttttcatgtaacataacatttggggattgggtttatttagtgtaatgaagataatttgatataaaaatattttgtgtatatatatatatttttactttgttttctaaattgctgtttgcagtaacagtaagcgcaaagcaaaatatataagttatgactgtatgatcagatgaagtatgagttcttttggtttgcatccttaaatagttagagatctctgataaaaactttggaatctttgcaaaacaatacaaaaatgccaaaatgtgagcatgtcaatgaaaactaaagacaaatacttcactctttttcatactattataagttattctggtattaaatatgttaataaaagtgtttttgttttgacatatttcagttaaatgaatgaatgctggttgtattttatttgaatgagtcatgattcatgtttgccatctttttaaaaaaatcagcaaatttcttctatgttataaattatagatgacaaggcaatataggacaactattcacatgattttttttaataccaaaggttggaagattttataattaacatgtcaagaagactttatagtaagcacatccttggtaatatctccaattgcaatgactttttaatttattttttcttttgctgctttaacattttctggatattaaaatccccccagtcctttaaaagaatcttgaacaatgctgagccggcagctgaaaatctaactcataatttatgttgtagagaaatagaattacctctattctttgttttgccatatgtaatcattttaataaaattaataactgccaggagttcttgacagatttaaaataaaagttaatttctagacctcg

SEQ ID NO: 18578 - DNA, 431 bp, Homo sapiens
aaggtctggtggagaggcgctcgggtagcggccaaggctggcccaagggtctgcgcggagcttgggagcccacctggccgcgcctcctttgctttaaaattattcgccggcgttgggggagggggacacttctgcagggagtgacctccccggccacagtctggagtgaatcgggaagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgaga

SEQ ID NO: 18579 - DNA, 1216 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaacccagaacggaagcgaggatgaggcctcagccgtcctcctccccattcaaacacgttcatccctcaaccctctgctgagcacctgcatgctgcccggccgcagtgtcacccttcttgtgtga

SEQ ID NO: 18580 - DNA, 1940 bp, Homo sapiens
atcttgcgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 18581 - DNA, 6160 bp, Homo sapiens
ctggatggactagccggggccatggccggcgcggcggcggagtcagggcgggagctgtggaccttcgcgggttcccgggacccgagcgcaccgcggctagcctacggctacggcccgggcagcctgcgcgagctgcgggcgcgcgagttcagccgcctggcaggaactgtctatcttgaccatgcaggtgccaccttgttctcccagagccagctcgaaagcttcactagtgatctcatggaaaacacttatggtaatcctcacagccagaacatcagcagcaagctcacccatgacactgtggagcaggtgcgctacagaatcctggcgcacttccacaccaccgcagaagactacactgtgatcttcactgccgggagcacggctgctctcaaactggtggcagaggcctttccatgggtgtcccagggcccagagagcagtgggagtcgcttctgttacctcaccgacagccacacctccgtagtgggtatgcggaacgtgaccatggctataaatgtcatatccaccccggtcaggccagaggacctgtggtctgcagaggaacgtagtgcttcagccagcaacccagactgccagctgccgcatctcttctgctacccagctcagagtaacttttctggagtcagataccccctgtcctggatagaagaggtcaagtctgggcggttgcaccctgtgagcacgcctgggaagtggtttgtgctgctggatgcagcctcctacgtgagcacctcgcctttggacctgtcagctcaccaggccgactttgtccccatctccttctataagatcttcgggtttcctacaggcctgggcgctctgctggtccataatcgtgcggctcctctactgaggaagacctactttggaggagggacagcctctgcgtacctagcaggagaagacttctacatcccgaggcagtcggtagctcagaggtttgaagatggcaccatctcattccttgatgttatcgcgctaaaacatggatttgacaccctagagcgcctcacaggtggaatggagaatataaagcagcacaccttcaccttggctcagtatacctacgtggccctgtcctctctccagtaccccaatggagcccctgtggtgcggatttacagcgattctgagttcagcagccctgaggttcagggcccaatcatcaattttaatgtgctggatgacaaagggaacatcattggttactcccaggtggacaaaatggccagtctttacaacatccacctgcgaactggctgcttctgtaacactggggcctgccagaggcacctgggcataagcaacgagatggtcaggaagcattttcaggctggtcatgtctgtggggacaatatggacctcatagatgggcagcccacaggatctgtgaggatttcatttggatacatgtcgacgctggatgatgtccaggcctttcttaggttcatcatagacactcgcctgcactcatcaggggactggcctgtccctcaggcccatgctgacaccggggagactggagccccatcagcagacagccaggctgatgttatacctgctgtcatgggcagacgtagcctctcgcctcaggaagatgccctcacaggctccagggtttggaacaactcgtctactgtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtcaacattttttggccgtccttgtcatttgatcaaacaaagttcaaactctcaaaggaatgcaaagaagaaacatggaaaagatcaacttcctggtacaatggccaccctttctctggtgaatgaggcacagtatctgctgatcaacacatccagtattttggaacttcaccggcaactaaacaccagtgatgagaatggaaaggaggaattattctcactgaaggatctcagcttgcgttttcgtgccaatattattatcaatggaaaaagggcttttgaagaagagaaatgggatgagatttcaattggctctttgcgtttccaggttttggggccttgtcacagatgccagatgatttgcatcgaccagcaaactgggcaacgaaaccagcatgttttccaaaaactttctgagagtcgtgaaacaaaggtgaactttggcatgtacctgatgcatgcatcattggatttatcctccccatgtttcctgtctgtaggatctcaggtgctccctgtgttgaaagagaatgtggaaggtcatgatttacctgcatctgagaaacaccaggatgttacctcctaaaaaaaatttttagcataaagtttctcttttacagtgatctctattattgttaagatctgcaacttggttcagtagaacttgatgttttgaataaggagagctctttttctttagaggcagggaatgctctcacctgcttccttctgcctttgacttctcaccctgcaaatttgcactggctgtgctcaggagagcacttctgaggcctcaggaacgaatgctgcacccacatccagtgaggctcctgtaggtatttgaagtataatcacttgtaatcagatgaaatttttaatgaagttcactgggaagattgaacttactgcgggtccctattttgccattttctcacattgttactttgtttttagagagcatctttggatctctccaacccgtttgtagtgaggaagggagtctatgcccagtgatcctgggtatgagaaggtgctcctctcctcccatgtacatgatggtgtgggtttatgctcaggggcccagagggtaacttgtgaccacattccttgaggggagtttctaccagaatatttatattctgagcaaaggcacaggccagcaattcctttcctgttgcttcccatccctggcctccgtcctcatcccccactgagttgatgcactgaggatggctcacgagcctgaagttacactcagtgatggctgtgcttatgcaggttgtcatcctcccctccacaagcccacaggatggtgttggtccatcacccgagagcctccaaatcctatcgagggaggaactttggcattcaggaatcctgtctgtatcatctttgaccactgctcctgcagcctccagatgaaaatgtccagtgaggaaatctcattctctaatgaagttacccatcccgctgagtttctaagaagtttctccctgtgcggagcttgtgtgtgccttatctgcttctgcatgacttccagcctggggtcttaccctgtcctctggagcaatgcagagtgagtacatccactccacattcattctgctggcgtccttctgaagcctgctgtccatgtgtgaacccagtcccttcatcatcttccccctggatggttgtatttttccagtcacttctcccccaaatgtctgcctgctgcagcccactgcatcttttgaaagcctgtgccaccccatctctcctgctgctcagttggagagcaggctccaggctcaggcttccctaatgtatctgttcagagcctgtgggattcagggtcagtttgtttcattatcacatttgtaggactttgtgttgttcccagcactaggtgagatttgaaagatgaggtgtgctctgttctcaaggattgttgagatggagcctaatgattgcacactcacgtgctgtgaagagttaagggtaaaaagtacaactctgactctggttcctgagatcaccgaaagaagaggcaaatgaagttaggtggggtggggtggggtttattgttttgaactgtttattaaaaacgcaacctcttcaaagactcagcactgccacatcatatgagtggacttgtcctcatcagctaactgataggagaacaatgccctaaagtaatggatttatccacctactcaggccagtttcatgcaggagggaactttccagatggcacattgccccatttccaagaccttccgctgacaaatgcatcatattaattatgatggaaaacaagtaagaaggcatgctctacaaaaattaggtcacttgcccaggtgcggtggctcacacctgtaattccagcactttgggaggctgacgtgggcagatcatgaggtcaggagatcgagaccatcctggctaacacggtgaaaccccgtctctactaaaatacaaaaaattagctgggcatggtggcatgcacctgtagtcccagctacttgggaggctgaggcaggggaatcgcttgaacccgggaggcggaggttgcagtgagccgagatcatgccactgcacaccggcctggtgacagagcaagactccatctcaaaaaaaaaaaaaaaaaaattaggtcacttttgtcatcaagaatatgtttttcttatccacgtctatgtcaccttttgcagtagatactttcatgactgatttcaggctttttgtttttttgagacagggtctcactctgtcacccaggctggagtgcagtggcatgatcacagatcattgcagccttgacctcttgggctcaagcgattcccctgcctcagcctcccaagtagctgggactacaggcacacatcaccacatccagctaattttttttttcttttttttctttttggtagagatggcatctcactttgttgcccaggctagttttgaattcctgggctcaagccatcctcccgccacagcctcccaaagttctgggattacaagtgtgagccactgtgcccagcttttgatttcagacattttaatgcagatcctctcctttacagcactattatttggttatctacttataattactgatttaacattgatctgttttcactagactgtaagctccatgaggacaagtcctgtgccagtatatctctagtgtcagcagacaatactcaaaatttgttgacagactatttaaagctgcccctatttttatcattaattgattgaatattaattaaatatattttattaatttaaaatgaattttaaatgcattttttctttagtgtctaccttcaatatttcttgtatgaagtttcagctaaaaatgtactttgtgtatctgtagagtggcttcatattcagagtttatggacatttatgattttatgtcccctccttggttcttatctcctggagttcagccttatgtgcttctcaaagtgtataacaaaatcaaagacaatgtcatgtcccttgaatttaattctaacaccaaaccttggtgttagagtcacaaaaagtccttttttaaaaaaacttggtgagaacagacaataacttgtctttctgggcattcgcgtcatggtccttttagccagaagagaggttttcttttgcatagtttggtgagcatcaagaatcctttaaggagggtggcggtgctgacttctccccattgagagtcagcctcatcccctcctcagccttgtggatggagaagaacaggcagtgatatacattttctgctgttgaaagatgtccgcttatccttctctttcagtgaaaagttgcttttttattcaatatgtactgaacaggttctagagtttcagaaacaaaagaaacagaaccaacatttatagatctcactatagaggcatcactaattggggaaagacagactaggtaatagtcagatgtgatatagtatgtttaagctataggatggcaggtgcatgagtgttggttgtattattctttatttttttgtatgacttatgatattcatgataattaaaacgttttggaacaattca

SEQ ID NO: 18582 - DNA, 4096 bp, Homo sapiens
gcgtcctcgcctattggctgcgcgggtcccgccctccccctgcccctccccgcccttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcagagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaagggtgtactctctgtatagccccgctatgggaaaataaagtggagtagggggcatagaaatgcaccatctaagggaaatcttttgtcaggtggtggccaggggtgttcaaagctcattgcttgcattaccagctattagagagatcagagagggcaattaattagaggctcctggttctcacatcccaaacacacacagttctggcctgctgggctctctaacttggatgtctttgagtcctcagtggtgccccctgcctgcctcccctctgccctatgccaaggtgtgctggcaaatattaaacaaccagctctctggaaaagacaatttgtgatataaatactcccatgttgaataatttcaagctaccagtatgtcaaatggcttgcaaaatttctgaaaatgtaaacaattggttctcacagagctggtacaagctggctccagcacactctcagcccaccccagatcccctcataggaagaaggcacaagtttaaaggcagactgggtagggatggtatgaatttaatattttttagtattacaatatattcttataaaaaaggtgcaagtgaaaaaggacactgtagattatgtccattagcctcatttgtcatctgaggcagctggtgagaacagccttggcgtgaaggcatccctggtagaagtcgggggagatagatagtcacagttccccagttggtggaaatgggatgggagtagggagaggctggaacagacccttccccattcacctggagaattttctcctcccactgccctaaacactttatttccatcacaggggagaaatgctgctgagaaggttgtgtttgttaggttgatgacgaattttacattggccacaaaattagctagagaaacttatctaaaggtggcaggagcagtggggagggcatgaagaaagcaagaccaagaaacaacctattaaggaccagctcagccaccccgactgggcaccagccccttcttactcagttgagtatgagtccatggtccaaggcactgttggagatctggctacagtggcatctagcaccagagccactggccagatgtagaaaataaatagaaaaatatctttcttttagagtga

SEQ ID NO: 18583 - DNA, 2747 bp, Homo sapiens
cttcatggcggcgcggccactgtcccggatgctgcggcggcttctgaggtccagcgcccggagctgcagctcaggggctccggtgacccagccctgccccggggagtccgcgcgagctgcctcggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcgagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttg

SEQ ID NO: 18584 - DNA, 1334 bp, Homo sapiens
gcgtcctcgcctattggctgcgcgggtcccgccctccccctgcccctccccgcccttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactga

SEQ ID NO: 18585 - DNA, 3938 bp, Homo sapiens
atgtggaagagttggaagctccgcacagatgtcagagaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcggtgggtgacccatcaagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaagggtgtactctctgtatagccccgctatgggaaaataaagtggagtagggggcatagaaatgcaccatctaagggaaatcttttgtcaggtggtggccaggggtgttcaaagctcattgcttgcattaccagctattagagagatcagagagggcaattaattagaggctcctggttctcacatcccaaacacacacagttctggcctgctgggctctctaacttggatgtctttgagtcctcagtggtgccccctgcctgcctcccctctgccctatgccaaggtgtgctggcaaatattaaacaaccagctctctggaaaagacaatttgtgatataaatactcccatgttgaataatttcaagctaccagtatgtcaaatggcttgcaaaatttctgaaaatgtaaacaattggttctcacagagctggtacaagctggctccagcacactctcagcccaccccagatcccctcataggaagaaggcacaagtttaaaggcagactgggtagggatggtatgaatttaatattttttagtattacaatatattcttataaaaaaggtgcaagtgaaaaaggacactgtagattatgtccattagcctcatttgtcatctgaggcagctggtgagaacagccttggcgtgaaggcatccctggtagaagtcgggggagatagatagtcacagttccccagttggtggaaatgggatgggagtagggagaggctggaacagacccttccccattcacctggagaattttctcctcccactgccctaaacactttatttccatcacaggggagaaatgctgctgagaaggttgtgtttgttaggttgatgacgaattttacattggccacaaaattagctagagaaacttatctaaaggtggcaggagcagtggggagggcatgaagaaagcaagaccaagaaacaacctattaaggaccagctcagccaccccgactgggcaccagccccttcttactcagttgagtatgagtccatggtccaaggcactgttggagatctggctacagtggcatctagcaccagagccactggccagatgtagaaaataaatagaaaaatatctttcttttagagtga

SEQ ID NO: 18586 - DNA, 4256 bp, Homo sapiens
gccagaaatcttcccagtagagatcaccatccgcccccgacccccaagctgaatacttaaggggtgggtccttcccatcaagctgatttctcaacgagagggacaatcccagcttccccaacattgcagagcccaaacatgtggaagagttggaagctccgcacagatgtcagagtaagggagggggcaggcggttctccttgtgcctcttcccagcccggtagcaggggcccatgcttcctccctggtctgtcctcgcaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcggtgggtgacccatcaagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaagggtgtactctctgtatagccccgctatgggaaaataaagtggagtagggggcatagaaatgcaccatctaagggaaatcttttgtcaggtggtggccaggggtgttcaaagctcattgcttgcattaccagctattagagagatcagagagggcaattaattagaggctcctggttctcacatcccaaacacacacagttctggcctgctgggctctctaacttggatgtctttgagtcctcagtggtgccccctgcctgcctcccctctgccctatgccaaggtgtgctggcaaatattaaacaaccagctctctggaaaagacaatttgtgatataaatactcccatgttgaataatttcaagctaccagtatgtcaaatggcttgcaaaatttctgaaaatgtaaacaattggttctcacagagctggtacaagctggctccagcacactctcagcccaccccagatcccctcataggaagaaggcacaagtttaaaggcagactgggtagggatggtatgaatttaatattttttagtattacaatatattcttataaaaaaggtgcaagtgaaaaaggacactgtagattatgtccattagcctcatttgtcatctgaggcagctggtgagaacagccttggcgtgaaggcatccctggtagaagtcgggggagatagatagtcacagttccccagttggtggaaatgggatgggagtagggagaggctggaacagacccttccccattcacctggagaattttctcctcccactgccctaaacactttatttccatcacaggggagaaatgctgctgagaaggttgtgtttgttaggttgatgacgaattttacattggccacaaaattagctagagaaacttatctaaaggtggcaggagcagtggggagggcatgaagaaagcaagaccaagaaacaacctattaaggaccagctcagccaccccgactgggcaccagccccttcttactcagttgagtatgagtccatggtccaaggcactgttggagatctggctacagtggcatctagcaccagagccactggccagatgtagaaaataaatagaaaaatatctttcttttagagtgagaaggctgagctctggaacaacgtatttgtgtcctctgtcaacagttgaaccaaattctgcttttctgaagatcaaatgtatcttgaacagct

SEQ ID NO: 18587 - DNA, 3358 bp, Homo sapiens
gcgtcctcgcctattggctgcgcgggtcccgccctccccctgcccctccccgcccttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcggtgggtgacccatcaagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaagggtgtactctctgtatagccccgctatgggaaaataaagtggagtagggggcatagaaatgcaccatctaagggaaatcttttgtcaggtggtggccaggggtgttcaaagctcattgcttgcattaccagctattagagagatcagagagggcaattaattagaggctcctggttctcacatcccaaacacacacagttctggcctgctgggctctctaacttggatgtctttgagtcctcagtggtgccccctgcctgcctcccctctgccctatgccaaggtgtgctggcaaatattaaacaaccagctctctgg

SEQ ID NO: 18588 - DNA, 2852 bp, Homo sapiens
cttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcagagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaagggtgtactctctgtatagccccgctatgggaaaataaagtggagtagggggcatag

SEQ ID NO: 18589 - DNA, 1920 bp, Homo sapiens
agcccaaacatgtggaagagttggaagctccgcacagatgtcagagtaagggagggggcaggcggttctccttgtgcctcttcccagcccggtagcaggggcccatgcttcctccctggtctgtcctcgcaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcgagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttag

SEQ ID NO: 18590 - DNA, 1071 bp, Homo sapiens
atgtggaagagttggaagctccgcacagatgtcagagaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcggtgggtga

SEQ ID NO: 18591 - DNA, 3549 bp, Homo sapiens
gattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaagagtattttctttttttttaaattgcctaaaatagttctcattatggagatttctgggatttcagaatctataatcttaccagaaaactttttgttgttttttattagttgttaattttgtatcaatatacaaatcagcacaaaattgtcataaagctaactagcaacaaggtggtttgtgttgaaatgtttaggtaaacaatgccccaatttttaactggttaagctttatagtattttgatagacttgtacatataagtcccatatagttcttaaatttttttttccagctttatttaggtatacttgacaaaaattgtatgtatttaaagtatacaatgtgatttttgatacacatatacattgtgaggtgattaccataatccaactaattaacatattcctcagctcacatagtcccctcttctgtgtggtgagaatatttaaggtctactctcagcaaatttcaggtaaacacatagctcataaaataataaaatacaggcaaaatttgggcagtcggcatcatcacaaaatttgcattatgcatattaagaacaaaagctatactttcagacacttagattgaaggatttttttcttatgtctgggacaaataagaaacgtagtaatcctatttgttatatgtagtgaaaacatcttttacctaaggaacccatttattcaacaaatatttattgaatgcctgttttgtgccaggcacccacccagtgatctttttctgccaacctaaaataccttgaggaacactctgcatcttatctgtggctgggacccataggacagccacactgactttaggaatcacctggttacatcagttgatgcttgttcattagtccgtctggagagattgggccagaaggatactggaagggcagacaaaccctccgcctacttcctctgccgggttcgggttgcctgtttggtctcagccttaccttcacagttcagtgtcactctggcttgccatcgagcttccgcctgtccccattggagagaaggggtgggtgttggctgttgcattatatctaaaagcacattatcatggggttactgggtcactggacatttctaggattttggacataggttgttaaatggatgttatgtcatatgcaatgttgataggtatatgtggatttcaagactttcctacttagatatttctttagaagttccttattgagggtaatgatgtttttaaagaacatagaacattctttatgttttaaaagaatcatgccttcattaagtaggctttattctaagtttggaactgagactgttatgcttttaaagtctccaacagagaggttaaggagttaacctggggcatgccagaactgggatggaatggccttgaaagattttagtgcattgcacttgacttagataggatctttactgacccttgcttacttaggagtggcagagttaattggtggttcagatattaaggggctactgtcactctgatatgtagcttttctatcatctctgtaacttagcttcaagtaactagaagagtaatctaaaaaaaataattagcctttaatcagattgcctgcagtgtttcttggtcactttaaagccgtgactttgcatgattgctaggtaagttcacttaagaaataggaaattcaaattatttatgtttcaagtatttttgaacaggtggtaaaatgaaattgatttttatcatctttgaatgaaagtaacagcagatattcaatgagtgacttattttgtggacatttttgtcctttggatatgatgtatagagtcacaatatattttcagccttttttgagaaataagtgatttagacatcttacacagttactgagcacctggtacagtgaagatctctcaagaatgatttgtgtgatgtagttcggtggatcatccagcagagggcagtagagccagagccatagtaaaagttatagtaaagttgctcttagcaacttgagtcttacttagatttaattttgcatagaaccaaaagttcagtttagtagccattttctttaaagtcaggctgtagtggttccgaaatgaaaattaggccctgattttatgtaagatgatgtccaatctttaattgacaccttaaaaatattaaaagattatgataggatcaggaaggagtttttgaaaatgcaatttgtagtttttaacaagtgatgtagaataaataaaaagaagtactttttaaaaagtaagtataaaattattttccagttaactatgggatataaatgattgctttaatacaggtcttcctaacctgtacagcatttcctaacctgctctgtgaaaaacaaagaaataaaacttagtgctctctttctc

SEQ ID NO: 18592 - DNA, 1781 bp, Homo sapiens
gattcggtcccgctgtcctaggcgggatggtgccgctgtgccaggtaagggtggcgggtgtgcgtgcgggcctgggtgcggagccctcctcgacgtgtctctcccgccctttccctccacatacccagccttggtcagtcggacctccccactagcccccaacctggccggcgtcttgggttcgggggcgcccccgcccccgcccccgggcccttcctgtctccgggctttactgcgactgccccagcagaagtcgggtcctctccgagaactcttgtcagctcacggcagcaaggacggactcgttctgaaggcgcctccaccttttatgaccacctctttcccagattattcgttttgatgaagctaaaattttaatctaaaaagaaatgcacctcatggagaattcttgtgaagaactgtgcttcatctgtggatttctacacccttgatcatttgcaaacctgtaattatttcgtaaagagttgtttgcacggagtgacaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaa

SEQ ID NO: 18593 - DNA, 1347 bp, Homo sapiens
tgcgcctttgcggccgtgattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaagagtattttc

SEQ ID NO: 18594 - DNA, 1210 bp, Homo sapiens
cggccgtgattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggtagaatggtctatttttaatacctgttatgattttgttttttaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaa

SEQ ID NO: 18595 - DNA, 1406 bp, Homo sapiens
cctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaagagtattttctttttttttaaattgcctaaaatagttctcattatggagatttctgggatttcagaatctataatcttaccagaaaactttttgttgttttttattagttgttaattttgtatcaatatacaaatcagcacaaaattgt

SEQ ID NO: 18596 - DNA, 707 bp, Homo sapiens
cgcaggcggcaagtgtccaggagtctggcgtctgctcgcctgcaccacgacctccctcctggggagaaggacatgcatggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctat

SEQ ID NO: 18597 - DNA, 6088 bp, Homo sapiens
acgccaaccactggtaagcgaagtgggcctcgctctcccgggttagcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcgaaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggttgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaaggtggccttcagtgtccacctgtggaacccaggacacagcacctgactgcacacagtggctgaaatccagcatttttacataggagatgcacttagcctctaagcctcgttttactcatctgtgaaacagagataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcccttgtttgtggagttacagcctcaaggttgtagcatgtgtgctggcaatcagggccgcagtgtgttctgcgcctgcccagagctgactcctgatttaaccgctggcgtaaccgcgggttgcacgcatgcgtgctgaaaagcctttcaccctcacgtggtttcttttttaaccagtcatcaagcgaggctcgcgcgcaggccccgcgttggaaaatggcggggaagctgaaacctctgaatgtggaggcgccagaagctactgaggaggctgaaggtagtgagggcaagtgggctgcactcctttctctccaaccagggcagaaaggagggaggattcgtcccattacaataatgaaataatgatattctaatttttttaaataaaatgttaagccttttgttattgaagaaaaacaattttttaaccgttcagcacagtggagataaattaacaggcatattcttatcaccgagattaacttttgtcaactgtagtgtatacgttgttgaaagtaaacaacatgtagttcagtacgaaagtcttcaaacaaaagtggggcggtggggatgttctcataacaatcaccgtgctgcagccaccccttattaacagtaattcccagtgtcgccatttcacacctaacacatatgacactttgatggactcttaaacctcctaatcgaacatggcctcccccacagcctcttttctccagggtattgacttgaatgacaggcaaaggagggtggaggggtgtcggcctagacactattggaaattgtattccatccaaaagaaaaaaaaatctcaggccgggcacggaggctcacgcctgtaatcccagcactttgggaggccgaggcgggcggatcacgaggttaggagttcgaggccagcctgaccaacatggtgaaacaccatctctactaaaaaactatatatacatatacatatgtgtgtatgtgtatttatatgtatgtatgtatgtgtgtgtatatatatatatatgtatatgtgtatatatatatatatgtgtatatatatatatatatacacacactaatcagccgggcgcggtggtgtgggcctgtaatcgcagctactcaggaagctgaggcaggagaatcacttgaacccgagaggcggaggttgcagtgagccgagatcatgtcactgcactccagcctgggtgacagagtgagactccgtctcaaaagaaaaaaaattctcccttggccgggcttggtggcttatgcctgtaatcccagcactttggaaggccgaggcgggtgggtcacctgaggtcaggagtttgagaccagcctggccagcatggcgaaacctcgtctctactaaaaatacaaaaattgtccgggtgtggtggcgggcgcctgtagtcccagctactggggaggctgaggcaggggaattgcttgaacccgggaggcagaggttatcgtgagctgacattgcgccactgcactccagcgcggaagacagagtgagcaaaaaaaaaaaaaaaaaaagaaaaaacaaaaagaaaaaaatctcccaaggcagtcatgcatttgtatgccactagcatttttttgttatagaaatattcaaagtgtaccaacgtagagaaaatagctttaaacaaagcccatgtgtacctatcagtatgctttaactgttgtcacctttctgccccacttttatctatctcgaacacccctttctgcacactctttaaaccactgtattaacaaacacattagactgcatcctgccagacctacccatacagacatcaaagtaatgattattgcttattgcctgacctaggatgtgagctccatgagaacagagactgtttacctctcgctcccctgcacctaaaacaatgcctgcttggtgtaaagtaagtgctcagtaattttttaatgtgtgaccaatgaaataacttcaagagcagagagctcttttagattagaggcacatactaagtgccagcattcaacaaaagacagacggaaataagacagatgcaaatagatctcatttattaactgtgtaatgcagctgccactgcaattaaaaaaaaaattttagtatcaacctttcaaattcctcaaaattaaagttatgactaacttcaccagcaaaggaaaaattgaaggatgtatcaagttgccatttctagcccatcaaatcggctttataaagggaagcatagtatctggtattgacgaccttgtagagaaacaggccttttcctgcctcagggaagagagctgactcaaagtaaaggctttgctagaggcagtcggcagagtatttttagcatctaaaatgctcttccacttcggcagtgaccatgcgatgtaatcaaaggagaatacgtaagtgtatggaccaggaatggtcactggagtgttgatgtaggcacaacacaagaagtagtcacagaaattgctaagtctaggtttatgtgtgcatgctgtggagtgtctctgtggtggatttctttttaagaggcagaaaaaaattctaatttaaatgtattaaattataagttctaatttaaatgtattaaaattaaattataagttgataggattattattgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaaggaatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcatattggatcagtattaacatccaggttttgattgttgtactatggttacctggtagattccctttgtatataggaaatagacactggaatagtaaggagtagtgggtcaagatgtctgcaacttattgttcagaatcactcacaaatgggaaatctgatataaggacaaaatgggagcactgtggcctatttttacaacttttgtgtacatctgcaattgtttcaaaataaaatgtttaaaagggtgctctta

SEQ ID NO: 18598 - DNA, 768 bp, Homo sapiens
gcgaagtgggcctcgctctcccgggttagcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaacggctgtcggacctgtaccaccgcctgcatgctcgtctccacagcacctcccgacccctgcgcctcatttaccacgtggctgagaaggagacactactggcctgggtaa

SEQ ID NO: 18599 - DNA, 1759 bp, Homo sapiens
gtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacagaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcgaaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggttgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggc

SEQ ID NO: 18600 - DNA, 1814 bp, Homo sapiens
ccaccgccgctacggggaagtaatggtatccggccaattgagattcggagttaaaacagaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcgaaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggttgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaag

SEQ ID NO: 18601 - DNA, 4015 bp, Homo sapiens
cgggtatcaaaagaaggatcggctccgcccccgggctccccgggggagttgatagaagggtccttcccaccctttgccgtccccactcctgtgcctacgacccaggagcgtgtcagccaaagcatggagaatcaagagaaggcgagtatcgcgggccacatgttcgacgtagtcgtgatcggaggtggcatttcaggactatctgctgccaaactcttgactgaatatggcgttagtgttttggttttagaagctcgggacagggttggaggaagaacatatactataaggaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggggaaaacatatccatttcggggcgcctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaagactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcggcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagatatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgctagcttatttgtatttttcctctttcacttcttatggaggagagtgtttaactgagttagaatgttgaaactgacttgctgtgacttatgtgcagctttccagttgagcagaggaaaatagtggcaggactgtcccccaggaggactccctgcttagctctgtgggagaccaactacgactggcatcttctcttccccctggaaggcagctagacaccaatggatccttgtcagttgtaacattctatttcaacttcaggaaagcagcagttttcttttaatttttcctatgaccataaaattagacatacctctcaacttacatatgtcttcaacatggttacctctgcataaatattagcaaagcatgccaatttctcttaagtactgaaatacatatgataaatttgactgttatttgttgagactatcaaacagaaaagaaattagggctctaatttccttaaagcaagctcacttgctttagttgttaagttttataaaagacatgaaattgagtcattttatatatgaaaactaagttctctatcttaggagtaatgtcggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatggattgggtatcaaaatgaatgccagtccagatgtgcctagacacgaaattggagctgaggactctcacgatatgcaagttcatccaacgtgaagataccataagctttttctctgaaccagagaaatgaaagtcagtttaagaggctgatagatcttggccctgttaaggcatccacttcacagttctgaaggctgagtcagccccactccacagttaggccaagaattagattttaaaacttcatctgtctgtcccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactgccacccccaatgca

SEQ ID NO: 18602 - DNA, 2383 bp, Homo sapiens
cccactcctgtgcctacgacccaggagcgtgtcagccaaagcatggagaatcaagagaaggcgagtatcgcgggccacatgttcgacgtagtcgtgatcggaggtggcatttcaggccaagagaagagattggcatgaactgttgctttgccagttccagccagtaccagcaaaaacatacatgtatgttggagcatcagaggaaagcagctcctggtggagagactatctgctgccaaactcttgactgaatatggcgttagtgttttggttttagaagctcgggacagggttggaggaagaacatatactataaggaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggggaaaacatatccatttcggggcgcctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaagactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcggcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagatatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgcta

SEQ ID NO: 18603 - DNA, 2566 bp, Homo sapiens
atagcggctcgccgaggcgctggtgcacgggggcagcgcgcagcaggccggcgggcaggcgggcgggctggctggcacgcaggactgggatcgaggcccagaaaacggagcagcgggcaccagggaggcctggaacggggcgagcgccatgagcaacaaatgcgacgtggtcgtggtggggggcggcatctcaggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagaaaagaactggtgtgaggagcagtactctgggggctgctacacaacttatttcccccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcagtaaagttccatgaagacaaatagtgtggagtgaggcggggagcatgaagataaatccaactctgactgtaaaatacatggtatctctttctccgttgtggcccctgcttagtgtcccttacctggcttagcgttctgtttcaccagtttccaagtttattgccctcaaaatctttagaatagttaaattggcttgtttaaggttcttgctgccccacaacacaccttgcccatgcacaaggaatgaattttttcctaccattatggctttgtgcttgttcttcctcttacctgtaatagcctcaccttccctagttctttgcattcgtccttagaatactgtattgttacagctgaaagacagtaaagaccatttagtcctcaccttctgttttagagttgagcaaactgaagcccacagaggtggaacttaattacctaagagccacaataagccactggtatctgggggactagaacacaaatccaacgcttttcccacctctttggatgttttccccaattatcctccttcactccctgtcatagttaccgatggtgtcccgttgtgtgggtttactctgtgctaagttgtcttacacttctcaaatgctactcagtatatagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccat

SEQ ID NO: 18604 - DNA, 1862 bp, Homo sapiens
agaaaacggagcagcgggcaccagggaggcctggaacggggcgagcgccatgagcaacaaatgcgacgtggtcgtggtggggggcggcatctcagaaacatcagactctgggcctctattgacaaaccgtatccacttgtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagaaaagaactggtgtgaggagcagtactctgggggctgctacacaacttatttcccccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcagtaaagttccatgaagacaaatagtgtggagtgaggcggggagcatgaagataaatccaactctgactgtaaaatacatggtatctctttctccgttgtggcccctgcttagtgtcccttacctggcttagcgttc

SEQ ID NO: 18605 - DNA, 1660 bp, Homo sapiens
aagccagtttgaacttaaggaggaggaactatttggccaaaacacctcctaatatgtagttcagtagagatgccctggagaatgctgcactgttccacatgcctgcaaatattcctctaatgatacagtcccaaggctttggacattgatagactccaggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcagtaaagttcca

SEQ ID NO: 18606 - DNA, 2335 bp, Homo sapiens
gctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcggtacaagcttgtggagcttctctgctacgtcgtaatgggcttcttccccgccctggtcatcctctccatgcccaacaccgagggcatctgggagctggtgaccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatgaggtgacccagacttgagaggtcgtttgggctttaggagtggagcacgtttctgtgaacgttaacccagagcacagcgccaaggcctgtcttccctttattgggtagagttcttgatggctccaaggtgacttctggtgacagccagatcatccctcgagtccccagcgagaaagaaagcatttagccattcttacagaggagaaattaaccctgtaatgtgtttctattttagatgagtgtttcctaatacaagcaacattaacatcttcagaaaaggaagcaggcatggtcctggaaaattggggaatgacgggccaatctgtgtttcctaaggtcctgaagaatctggcaaagagtcctgtgggttgtttatacctgggtggccagggcctccctctctgttaccaaagtccaggctggcgaattgtctctggttcagggaaaggggacagcccagcttgaagatgagggatggtgaatggctgtgaccatggcagacatcaccaatcaagtgcagcacatgggtgatgtcagaattcttcccagcacagtgttctgggcagccagtaccaatcaatttggcactcatgatgggacctctttgcccttcctgtctggtgtgctctgaaatgggataatggccagagtagctgaaaatctccaaatgggcatttgcatgcctatctcctcatctccccctcccttttgggaaactcctggagtaggcagtttgggggcggtagagggaaactgaggcgcacacccatgcagcccctgatgttctgttccaccgtagttgattctcagtagagttgggaatgaggatgctgttacttggccatttcttcccatctccaaaaatccagagacattacgagagctattcattcataagatggggcaaacagcccccaggcacttgctccctgctccatacttaaggtttgtgatgccaacatttggattctctcttggtgccaatcagtggctgttagaggctactcaggtgtaccccaaacagaaggcacatggatctggggcgactgttccaggtcctcccaacctctgaagtgctcagtagcccaacaacaaggctgctgggggcctgttcttcagcccccgtcagggcggggccagcctctctgtccaatgctgcctggacatttactggggaggtgagtagcaggcccagctccaggatctgaattggaatctcagattctctggataaagaatctgtctcaagtcaggaggtcctcattctgcgactcccaaccagggtggagtgggcacagacaggatgccttatgcttatctctagcacattccagggggttccagggttcctgcacctggaatccagtgtgtccaagccagtattaaattatctcaacaca

SEQ ID NO: 18607 - DNA, 2415 bp, Homo sapiens
ctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcgaacagggagctgtgtgcagtttcttcgtggggaggcatgtcctaaggccggcacggcttgtcttcctgccaggtacaagcttgtggagcttctctgctacgtcgtaatgggcttcttccccgccctggtcatcctctccatgcccaacaccgagggcatctgggagctggtgaccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatgaggtgacccagacttgagaggtcgtttgggctttaggagtggagcacgtttctgtgaacgttaacccagagcacagcgccaaggcctgtcttccctttattgggtagagttcttgatggctccaaggtgacttctggtgacagccagatcatccctcgagtccccagcgagaaagaaagcatttagccattcttacagaggagaaattaaccctgtaatgtgtttctattttagatgagtgtttcctaatacaagcaacattaacatcttcagaaaaggaagcaggcatggtcctggaaaattggggaatgacgggccaatctgtgtttcctaaggtcctgaagaatctggcaaagagtcctgtgggttgtttatacctgggtggccagggcctccctctctgttaccaaagtccaggctggcgaattgtctctggttcagggaaaggggacagcccagcttgaagatgagggatggtgaatggctgtgaccatggcagacatcaccaatcaagtgcagcacatgggtgatgtcagaattcttcccagcacagtgttctgggcagccagtaccaatcaatttggcactcatgatgggacctctttgcccttcctgtctggtgtgctctgaaatgggataatggccagagtagctgaaaatctccaaatgggcatttgcatgcctatctcctcatctccccctcccttttgggaaactcctggagtaggcagtttgggggcggtagagggaaactgaggcgcacacccatgcagcccctgatgttctgttccaccgtagttgattctcagtagagttgggaatgaggatgctgttacttggccatttcttcccatctccaaaaatccagagacattacgagagctattcattcataagatggggcaaacagcccccaggcacttgctccctgctccatacttaaggtttgtgatgccaacatttggattctctcttggtgccaatcagtggctgttagaggctactcaggtgtaccccaaacagaaggcacatggatctggggcgactgttccaggtcctcccaacctctgaagtgctcagtagcccaacaacaaggctgctgggggcctgttcttcagcccccgtcagggcggggccagcctctctgtccaatgctgcctggacatttactggggaggtgagtagcaggcccagctccaggatctgaattggaatctcagattctctggataaagaatctgtctcaagtcaggaggtcctcattctgcgactcccaaccagggtggagtgggcacagacaggatgccttatgcttatctctagcacattccagggggttccagggttcctgcacctggaatccagtgtgtccaagccagtattaaattatctcaacacattccacaga

SEQ ID NO: 18608 - DNA, 2372 bp, Homo sapiens
ctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcggtacaagcttgtggagcttctctgctacgtcgtaatgggcttcttccccgccctggtcatcctctccatggcggggaaactgaggcctggcatgacttgtctaaagaggcagtaggccagcccaacaccgagggcatctgggagctggtgaccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatgaggtgacccagacttgagaggtcgtttgggctttaggagtggagcacgtttctgtgaacgttaacccagagcacagcgccaaggcctgtcttccctttattgggtagagttcttgatggctccaaggtgacttctggtgacagccagatcatccctcgagtccccagcgagaaagaaagcatttagccattcttacagaggagaaattaaccctgtaatgtgtttctattttagatgagtgtttcctaatacaagcaacattaacatcttcagaaaaggaagcaggcatggtcctggaaaattggggaatgacgggccaatctgtgtttcctaaggtcctgaagaatctggcaaagagtcctgtgggttgtttatacctgggtggccagggcctccctctctgttaccaaagtccaggctggcgaattgtctctggttcagggaaaggggacagcccagcttgaagatgagggatggtgaatggctgtgaccatggcagacatcaccaatcaagtgcagcacatgggtgatgtcagaattcttcccagcacagtgttctgggcagccagtaccaatcaatttggcactcatgatgggacctctttgcccttcctgtctggtgtgctctgaaatgggataatggccagagtagctgaaaatctccaaatgggcatttgcatgcctatctcctcatctccccctcccttttgggaaactcctggagtaggcagtttgggggcggtagagggaaactgaggcgcacacccatgcagcccctgatgttctgttccaccgtagttgattctcagtagagttgggaatgaggatgctgttacttggccatttcttcccatctccaaaaatccagagacattacgagagctattcattcataagatggggcaaacagcccccaggcacttgctccctgctccatacttaaggtttgtgatgccaacatttggattctctcttggtgccaatcagtggctgttagaggctactcaggtgtaccccaaacagaaggcacatggatctggggcgactgttccaggtcctcccaacctctgaagtgctcagtagcccaacaacaaggctgctgggggcctgttcttcagcccccgtcagggcggggccagcctctctgtccaatgctgcctggacatttactggggaggtgagtagcaggcccagctccaggatctgaattggaatctcagattctctggataaagaatctgtctcaagtcaggaggtcctcattctgcgactcccaaccagggtggagtgggcacagacaggatgccttatgcttatctctagcacattccagggggttccagggttcctgcacctggaatccagtgtgtccaagccagtattaaattatctcaacacattccacaga

SEQ ID NO: 18609 - DNA, 4612 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcgg

SEQ ID NO: 18610 - DNA, 4187 bp, Homo sapiens
tggcggcgcagacgccgcaccctgtcgccgcgaagccggtcgcgcgcagctcgtcccggccctggcccgccgcaaacgaggatccgctgcgctcggggaacgcgacagcggcgctcgtggccccggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcgg

SEQ ID NO: 18611 - DNA, 4941 bp, Homo sapiens
gtcgccgcgaagccggtcgcgcgcagctcgtcccggccctggcccgccgcaaacgaggatccgctgcgctcggggaacgcgacagcggcgctcgtggccccggtaactgcctcccggcccctgccccagcccgccagtgccgccgtcaggggtggggagcagcactggggtcccggacacgcccggcgtgggctcccgctacccatgtgtgcgtgtgtgtgtgtgcacggtgtgtgtgcgcgcgtgtccgagtgtgcgcgcgtgtgcgcgcgcgcgcgccctccctgctccttcgcaccagcccccaaaccaacttgtccccatcaactccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 18612 - DNA, 966 bp, Homo sapiens
gtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgc

SEQ ID NO: 18613 - DNA, 410 bp, Homo sapiens
acagctaaaatagtctttaagatgaagtttcctgaaatgatttaaaataaacacagatgggaagggggaaaaactgtaatgaggcacttaaaaaataaagtgagcattttcttaagaacaaatgggatttttcagtcttggagaggtttgcaagaaatgacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatg

SEQ ID NO: 18614 - DNA, 1023 bp, Homo sapiens
atgaagacaagacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgc

SEQ ID NO: 18615 - DNA, 3059 bp, Homo sapiens
gcgcggccggcccgaggggcggtccctgggctcccgctcgccgccgctgccgctcctcgttctgctcctcactccccagcggctggaggccggtaccggcgggcaggaggcgcccgaggatgtgctgctggccgctgctcctgctgtgggggctgctccccgggacggcggcggggggctcgggccgaacctatccgcaccggaccctcctggactcggagggcaagtactggctgggctggagccagcggggcagccagatcgccttccgcctccaggtgcgcactgcaggctacgtgggcttcggcttctcgcccaccggggccatggcgtccgccgacatcgtcgtgggcggggtggcccacgggcggccctacctccaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtccccatcccaaacaaagatacaacatattggtgccaaatgtttaagattcctgtgttccaagaaaagcatcatgtaataaaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagagggcttttcttatccacctcatgttggattatcccttggcactccattagatccgcattatgtgctcctagaagtccattatgataatcccacttatgaggaaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccaggagataacctaattactgagtgtcgctacaacacgaaagatagagctgagatgacttggggaggactaagcaccaggagtgaaatgtgtctctcataccttctttattacccaagaattaatcttactcgatgtgcaagtattccagacattatggaacaacttcagttcattggggttaaggagatctacagaccagtcacgacctggcctttcattatcaaaagtcccaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcgattcaaggaatgacagcattacctccagatatagaaagaccctataaagcagaacctttggtgtgtggcacgtcttcttcctcttccctgcacagagatttctccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaataaaactggcctgacttaagataaccattttaaaaaattgggctgtcatgtgggaataaaagaattctttctttcctactacattctgttttatttaaatactcattgttgctatttcactttttgacttgacttttatatttctttaaaaaattccttccttttaaaaaatataaaagggactactgttcattccagttttcttcttctttgttgttcttctagtgtgacttttcaagtgtaacagccattcttcctgactttaatattgtccagttctggtcttttctgtgaattaccactgggccccttacctcaatgctttttgttgatgcccactctggttcccttgtttatctgagtctgttggtaccccaaatgaccccacacccatcttaaagtactttttttcaccttccctgtttagtactggccagatgagttttttctagagctctgtcactatctgaaaagaaagaggctatgggaaacatagaaatggtatgtattaataactgatcataggctgaggagaaaaaatgtagctggctgcaaacccagtgctgtgaggtgacttatatgaggttccagatcaaagacaggccgtgtgagccagtccaggagggtgtaagttctgaatggttccttgctgactttgggtgacacatgtaccacatactggctcagtttaagtcatggttctattgtagatttatttttatattagttaataaatgactttaaattgtcaccaattgaaaatcttgtcactcttttggttttctttatatagctcagccaaatcttgttttatgtcctgtcctcatctcttaagctaaatctgtttggatcatattaataaactaaatgaaattaca

SEQ ID NO: 18616 - DNA, 3764 bp, Homo sapiens
gtgggagtgggcgcgggcgcaggcgaacggctgccggtcaggtgtccttgtccccttgagttgcgcgggtcgtgttcgagggcatggacgacaggtaccctgcgcttcagcgggcccagctgcgtctggatttcatccacgccaactccaccactcacagtttcctttttggagcactggctgaattgctggacaatgcaagagatgcaggggctgaaagacttgatgtcttttcagtggataatgaaaaactgcaggggggattcatgttgtgtttcctggatgatggatgtggcatgagccctgaggaagcttcagacatcatttactttggacgatccaaaaaacggctgtcaaccttgaagttcatagggcaatacggcaatggtcttaaaagtgggtccatgagaattggaaaagactttattctttttacgaagaaggaagaaacgatgacctgtgtgtttttttctcagacattctgtgaagaagaaagtcttagtgaggttgtagttccaatgccctcatggttaataagaaccagagaatctgtcacagatgatccccagaaatttgcaatggaattatctataatttataaatactccccatttaaaactgaagcagaattgatgcagcagtttgatgtgatctatggaaaatgtggtactttgctggttatttataacttgaagcttctgcttaatggagaaccagagttggatgttaaaactgacaaagaagatatactgatggctggagctctggaggatttcccagcgaggtggtcattcagagcctacacatctgttctgtattttaacccatggatgagaatattcattcaagccaagagagttaaaactaaacatctttgctattgcctctacagacccagaaagtatctttatgtcacatcttcttttaaaggagcatttaaagatgaagttaaaaaggcagaagaagcagtaaagattgctgaatccatattgaaagaagcacaaatcaaagtaaaccagtgtgacagaacctctttatcttctgccaaggatgtattacagagagctttggaagatgtagaagcaaagcaaaagaatcttaaagagaaacaaagagaattaaaaacagcaagaacgctctccctgttctatggagtgaacgtagaaaaccgaagccaagctggaatgttcatttacagtaataaccgtttgatcaaaatgcatgaaaaagtgggctcacagttgaaactgaagtccttacttggcgcaggcgtggttggaattgttaatatacccttggaggtcatggaaccatcccataataaacaggaatttctcaatgtccaagagtataatcatctactaaaagtcatgggacagtacttggtccagtactgtaaggacaccggcatcaataatagaaatttaacattgttttgcaatgaatttggataccagaatgacatcgatgtggagaaacctttaaattcttttcaatatcaaagaagacaagccatgggtatcccattcatcatacaatgtgatctttgtcttaaatggagagtcttgccttcctctactaattatcaggaaaaagaattttttgacatttggatttgtgctaataatcccaaccgcttggaaaacagttgtcatcaggtagaatgtctaccttccatcccactgggcaccatgagcacaatatcaccatcaaaaaatgagaaagagaagcaacttagagagtcggtcataaagtatcaaaatagactggcagaacagcagccacagcctcaatttataccagtggacgaaatcactgtcacttccacctgcctaacttcagcacataaggaaaataccaaaacccagaaaatcaggcttttgggcgatgacttgaagcatgaatctctttcatcctttgagctttcagcgagccgtagaggacagaaaagaaacatagaagagacagactctgatgtagagtatatttcagaaacaaaaattatgaaaaagtctatggaggagaaaatgaactctcaacagcagagaattccagtagctctgccagaaaatgtcaaactagctgagagatcccagagaagtcagattgctaatattaccactgtctggagagctcaaccaactgaagggtgcctgaagaatgcccaggccgcttcttgggaaatgaaaaggaagcagagtctgaactttgtagaggaatgtaaggtattgactgaagatgagaacacgagtgattcagatataatcctggtttcagataaaagcaacactgatgtttcattgaaacaagaaaaaaaggaaattcctcttttaaaccaagaaaaacaggagctgtgcaatgatgttctagcaatgaaaagaagctcttcattacctagctggaaaagcttgctcaatgtgccgatggaagatgtgaatctaagttctggacacatagccagagtttctgtgagtggcagttgtaaagttgcttcttcgccagcgtcttctcaaagcacacctgtcaaggaaacagtgagaaaactgaagtctaagttaagggagattcttctgtatttttttcctgagcatcagctaccatcagaattggaagaacctgcattaagttgtgagctggagcagtgcccagagcagatgaacaaaaagctgaaaatgtgtttcaaccagatacagaatacttacatggtccaatatgaaaaaaaaataaagaggaaattgcagtccattatctatgattcaaatacaagaggaatacataatgaaatctctctggggcaatgtgaaaataaaagaaaaatctctgaggataagctgaagaatcttcgtataaaactggcactattgttgcagaaactccaactgggtggtccagaaggtgacctggagcagactgacacttatttagaagctttgcttaaagaagataatcttctcttccagaacaatttaaataaagtaactatagatgcaagacatagactccctttagaaaaaaatgaaaagacttcggaaaattaagtcagagatggtattaccttttaaaaaatgctaataagaaaattggaagattcttttaaaaatttttcttttttgttgttgttactgtaaagtctattctgtttaacaataagaaataagaaataatttttttcaaataagaaaattgtgtactctagaaatggagaccgatttacaatttatgtattccctaatccaattatctaaatcttccttttctttcagaaatattaataatatctagagttctctaattttcatgtgagctactgaaaaaaatgaaaatgtcactcaagcttaacttttgttattccttaaaagattgttattgtaattttgttattccttaaaaacatttaaaagcagattttttcaaaatcgatatgtgaaggactacagaatcacctcctcttgaagatattgaaaaagaaagacattatgccctttctccactatagccaacactcagtcaagcagaaaatacaaatccccccaaaactttgagacatagcttatataattttattatttagtcatagtaaaagaataaatctcctaagcataatatgtatacatattacacatatgtaaaaattgttgttttacatttacatatacgtaaagaagtatgtttttacacttttcttgataagtgttttttttttgtttagaaatgtctgaaactttagacaaaaacagtaaaacatttaatattcatttgtgaaa

SEQ ID NO: 18617 - DNA, 2359 bp, Homo sapiens
gcgtgcgcggcgggctgtcgttggctggagcagcggctgcgcgggtcgcggtgctgtgaggtctgcgggcgctggcaaatccggcccaggatgtagagctggcagtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaaaagtgctgtgaggcccaggcgctctgaaaaatctttgaagacacatgaggatattgtagccctttttcctgttcctgaaggagctccctcagtacaccaccccctcctgacctctagttgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaagaacaatgtgcttgtgttgatgccttacaaaaaccattgtatatttgtgtattccttcttgtatttagacagtggtttttcaggtgcgtgctttgttttctggtatggcctttatggaatgagacgctttagctttggtacgtagcgctaatccatagcagctttggcagtttgctgtcttgagtcttagctaaaaagttagaagtttacatgactgttttttttattttccctaaattattacttactctgagcattaattaagggcattttcacctgtgtaaaattatggtcagcttttttctgtctataattgtttacttttgtgggtttactctagaaacatgagccaaaaatgtcaatagacaacacagtattaaaataacccaaaagttgtaaa

SEQ ID NO: 18618 - DNA, 2274 bp, Homo sapiens
aacccatggccgggaaaagaagctcctgctccccgctccactcccggcgtcttcacacttggggaagggagaggcaggaagtgcaaggaccgcgcaagacccggccccccgagccgccaggggccgcgccagcagcccagatgcggtgggcgggagctgggggggcggcggggtcccgcgaagacctgcgacctggcgccctcgccggctgtgtcccggccagcccgctttccaggcgagcctcgctaaggagtgtgagaaaccaaatcctcagtgggtaaaccgcgctccgtccagcccactcggacgagagctctcccgggagccaggcgcgttgctgcacccgaggtggggaaaccggagcccgaagagcggaaggggcttattccaggcgacaggcagtgtcagtaactgaatcaggggccgaggaagtttccccagaagcgcggcttcgctcccggcccggcccgaccccgactactgtcccctaatacccagggagcggaagacgcgaccaactccaggcacagcggagccggcgcggggtccacaaagcaaaaaagaatgatccccttcccccatcctcaagtgactgatgctcttggaagatactccaactatatcctgagtagcactgtggagagccccagtctgagaagcatgaactttgagaagcaaggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttc

SEQ ID NO: 18619 - DNA, 1880 bp, Homo sapiens
agtcccggcgtgccctggggcggcgcgggcgcaggggcgcgtgcgcggcgggctgtcgttggctggagcagcggctgcgcgggtcgcggtgctgtgaggtctgcgggcgctggcaaatccggcccaggatgtagagctggcagtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaa

SEQ ID NO: 18620 - DNA, 855 bp, Homo sapiens
caggacccgaagcctaaattccaggaggttgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactct

SEQ ID NO: 18621 - DNA, 1468 bp, Homo sapiens
gaatcacttataaatggcgccgaagcaggacccgaagcctaaattccaggagggtgagtgtgcgcctttgggaaaaaggcacctaacggcgcaggagatagaggcgggctcgaggtgattgaggcttgagggccgggggcggcgcgggctgcgccctgagaaggcggcggtcagtgctttgtgcggggaaagcgcattgcggatggcaattccggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttat

SEQ ID NO: 18622 - DNA, 527 bp, Homo sapiens
gaagacaagcagagagactcctccagacccactcagaccacgtgcacgccctccaagatggtatcccgtaaggctgtggctgctctgctggtggtgcatgtagctgccatgctggcctcccagacggaagccttcgtccccatcttcacctatggcgaactccagaggatgcaggaaaaggaacggaataaagggcaaaagaaatccctgagtgtatggcagaggtctggggaggaaggtcctgtagaccctgcggagcccatcagggaagaagaaaacgaaatgatcaagctgactgctcctctggaaattggaatgaggatgaactccagacagctggaaaagtacccggccaccctggaagggctgctgagtgagatgcttccccagcatgccaagtgatggccacgctggggagaaggtggacagatttgggaggcccctcctgcccaagtgaggccctgggaatttacagagcctgccagctgggcttggaaggaaaacaccctttccaaagcaaattcccc

SEQ ID NO: 18623 - DNA, 566 bp, Homo sapiens
cggacaccagaagacaagcagagagactcctccagacccactcagaccacgtgcacgccctccaagatggtatcccgtaaggctgtggctgctctgctggtggtgcatgtagctgccatgctggcctcccagacggaagccttcgtccccatcttcacctatggcgaactccagaggatgcaggaaaaggaacggaataaagggcaaaagaaatccctgagtgtatggcagaggtctggggaggaaggtcctgtagaccctgcggagcccatcagggaagaagaaaacgaaatgatcaagctgactgctcctctggaaattggaatgaggatgaactccagacagctggaaaagtacccggccaccctggaagggctgctgagtgagatgcttccccagcatgcagccaagtgatggccacgctggggagaaggtggacagatttgggaggcccctcctgcccaagtgaggccctgggaatttacagagcctgccagctgggcttggaaggaaaacaccctttccaaagcaaattcccctccagcaaataaagcatgaaatataca

SEQ ID NO: 18624 - DNA, 400 bp, Homo sapiens
ccagacccactcagaccacgtgcacgccctccaagatggtatcccgtaaggctgtggctgctctgctggtggtgcatgtagctgccatgctggcctcccagacggaagccttcgtccccatcttcacctatggcgaactccagaggatgcaggaaaaggaacggaataaagggcaaaagaaatccctgagtgtatggcagaggtctggggaggaaggtcctgtagaccctgcggagcccatcagggaagaagaaaacgaaatgatcaagctgactgctcctctggaaattggaatgaggatgaactccagacagctggaaaagtacccggccaccctggaagggctgctgacagccaagtgatggccacgctggggagaaggtggacagatttgggaggc

SEQ ID NO: 18625 - DNA, 1239 bp, Homo sapiens
atgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacccggcgccgcgtccgcgcgctcatcgctgtgctctgggccgtggcgctgctctctgccggtcccttcttgttcctggtgggcgtcgagcaggaccccggcatctccgtagtcccgggcctcaatggcaccgcgcggatcgcctcctcgcctctcgcctcgtcgccgcctctctggctctcgcgggcgccaccgccgtccccgccgtcggggcccgagaccgcggaggccgcggcgctgttcagccgcgaatgccggccgagccccgcgcagctgggcgcgctgcgtgtcatgctgtgggtcaccaccgcctacttcttcctgccctttctgtgcctcagcatcctctacgggctcatcgggcgggagctgtggagcagccggcggccgctgcgaggcccggccgcctcggggcgggagagaggccaccggcagaccgtccgcgtcctgctggtggtggttctggcatttataatttgctggttgcccttccacgttggcagaatcatttacataaacacggaagattcgcggatgatgtacttctctcagtactttaacatcgtcgctctgcaacttttctatctgagcgcatctatcaacccaatcctctacaacctcatttcaaagaagtacagagcggcggcctttaaactgctgctcgcaaggaagtccaggccgagaggcttccacagaagcagggacactgcgggggaagttgcaggggacactggaggagacacggtgggctacaccgagacaagcgctaacgtgaagacgatgggataa

SEQ ID NO: 18626 - DNA, 1390 bp, Homo sapiens
atgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacccggcgccgcgtccgcgcgctcatcgctgtgctctgggccgtggcgctgctctctgccggtcccttcttgttcctggtgggcgtcgagcaggaccccggcatctccgtagtcccgggcctcaatggcaccgcgcggatcgcctcctcgcctctcgcctcgtcgccgcctctctggctctcgcgggcgccaccgccgtccccgccgtcggggcccgagaccgcggaggccgcggcgctgttcagccgcgaatgccggccgagccccgcgcagctgggcgcgctgcgtgtcatgctgtgggtcaccaccgcctacttcttcctgccctttctgtgcctcagcatcctctacgggctcatcgggcgggagctgtggagcagccggcggccgctgcgaggcccggccgcctcggggcgggagagaggccaccggcagaccgtccgcgtcctgcgtaagtggagccgccgtggttccaaagacgcctgcctgcagtccgccccgccggggaccgcgcaaacgctgggtccccttcccctgctcgcccagctctgggcgccgcttccagctccctttcctatttcgattccagcctccacccgccgtggtggtggttctggcatttataatttgctggttgcccttccacgttggcagaatcatttacataaacacggaagattcgcggatgatgtacttctctcagtactttaacatcgtcgctctgcaacttttctatctgagcgcatctatcaacccaatcctctacaacctcatttcaaagaagtacagagcggcggcctttaaactgctgctcgcaaggaagtccaggccgagaggcttccacagaagcagggacactgcgggggaagttgcaggggacactggaggagacacggtgggctacaccgagacaagcgctaacgtgaagacgatgggataa

SEQ ID NO: 18627 - DNA, 2068 bp, Homo sapiens
cggggcccgcacggaggaggcgccgggaccatggtcaccctcggctgagtttccggcggcgactttgattattggcaaataaccaccataacaataccgagcccccgggcttgcaccgcacgcactgactccgcgagcccgcacacggccgcgtcgcccgccaccgggccctgagcgccagccccaaacgagccgatggaaaaatccaaaaatttccgcatcgacgccctgctggcggtggaccccccacgagccgcctctgcgcagagcgcgccgctggccttggtcacgtcgctcgccgccgccgcatctggcaccggaggtggcggcggcggcggcggggcgagcggcgggactagcggcagctgcagccccgcgtcctcggagccgccggctgcgcccgccgaccgcctgcgcgccgagagcccgtcgccgccgcgcctgctggccgcgcactgcgcgctgctgcccaagccgggcttcctgggcgcgggcggcggcggcggcggcacgggcggcgggcacggggggccccaccaccacgcgcatccgggcgcagcggccgctgccgccgccgccgccgccgccgccgccgctgggggcctggcgctggggctgcaccctgggggcgcgcagggcggcgcgggcctcccggcgcaggcggcgctctacggccacccggtctacggctactccgcggcggcggcggcggctgcgctggcgggccagcacccggcgctctcctactcgtacccgcaggtgcaaggcgcgcaccccgcgcaccccgccgaccccatcaagctgggcgccggcaccttccagctggaccagtggctgcgcgcgtccaccgcgggcatgatcctgcctaagatgcccgacttcaactcccaggcgcagtcgaacctcctggggaagtgccgccggccgcgcaccgccttcaccagccagcagctgctggagctggagcaccagttcaagctcaacaagtacctgtcgcggcccaagcgcttcgaggtggccacctcgctcatgctcaccgagacccaggtgaagatttggttccagaaccggcggatgaaatggaaacgcagcaaaaaggccaaagagcaggcggcgcaggaagcggagaaacagaagggcggcggcgggggcgcggggaagggcggcgcggaggagccgggagccgaggagctgctggggccgccagcgcccggagacaagggcagcggacgccgcctgcgggacttgagggacagtgaccccgaggaggacgaggacgaggacgacgaggaccatttcccctacagcaacggcgccagcgtccacgccgcctcctccgactgctcctcggaggacgactcgccgcccccgcggcccagccaccagcccgcgccccagtaggagccccgcggcccagcaggtgcggcgcgcacggagcgccccggccggcggcttctcccggaggccccggcgcccgcacccacccggcccggccccgagagcaggctcgaccgccgccccatggacccctcgcccaggccggggctggagggattcggccgcggctccggtcctgggcgcttcccttttaagcaagggcgcctcacctgctcttcaagaaacagcgagagggagacccagggggctgaaacttgaactctggttcttttaaaattaattttggttggtgttgggggaggcgcgagtgcgtgtgagaagaaccgacccaccccgcgcaaggggaagcctcctgtctcccctttccccgcgtccgagaaggcggaaacccacagtgttacctgacttatgaaacttgaaaccgcctctggagccgccattctgcagagtatttggaaaaagaaaaaagggtttatgcttacgtctctggggtcggggggattatgtcacgagcgttcaaactgctggaaatctcaaaactgtactgtctttatttttgtatattgtatttatatataaaaagaaacgtctacgtatgcatgctaaattattatttagcttctcccatcgcccacgatggaatgtaaaataaattggttttgtactggat

SEQ ID NO: 18628 - DNA, 2029 bp, Homo sapiens
ggcgcgggtccccaccacggcggcagcggcctccgcgcggtcgcctgagggctgcagcgcaaagaaccgggctcccgggcccggacgcggggaagcactcgcgtgggagtttgtgcgagcgcggcccggggcggggcccgcacggaggaggcgccgggaccatggtcaccctcggctgagtttccggcggcgactttgattattggcaaataaccaccataacaataccgagcccccgggcttgcaccgcacgcactgactccgcgagcccgcacacggccgcgtcgcccgccaccgggccctgagcgccagccccaaacgagccgatggaaaaatccaaaaatttccgcatcgacgccctgctggcggtggaccccccacgagccgcctctgcgcagagcgcgccgctggccttggtcacgtcgctcgccgccgccgcatctggcaccggaggtggcggcggcggcggcggggcgagcggcgggactagcggcagctgcagccccgcgtcctcggagccgccggctgcgcccgccgaccgcctgcgcgccgagagcccgtcgccgccgcgcctgctggccgcgcactgcgcgctgctgcccaagccgggcttcctgggcgcgggcggcggcggcggcggcacgggcggcgggcacggggggccccaccaccacgcgcatcccggcggcggctgcgctggcgggccagcacccggcgctctcctactcgtacccgcaggtgcaaggcgcgcaccccgcgcaccccgccgaccccatcaagctgggcgccggcaccttccagctggaccagtggctgcgcgcgtccaccgcgggcatgatcctgcctaagatgcccgacttcaactcccaggcgcagtcgaacctcctggggaagtgccgccggccgcgcaccgccttcaccagccagcagctgctggagctggagcaccagttcaagctcaacaagtacctgtcgcggcccaagcgcttcgaggtggccacctcgctcatgctcaccgagacccaggtgaagatttggttccagaaccggcggatgaaatggaaacgcagcaaaaaggccaaagagcaggcggcgcaggaagcggagaaacagaagggcggcggcgggggcgcggggaagggcggcgcggaggagccgggagccgaggagctgctggggccgccagcgcccggagacaagggcagcggacgccgcctgcgggacttgagggacagtgaccccgaggaggacgaggacgaggacgacgaggaccatttcccctacagcaacggcgccagcgtccacgccgcctcctccgactgctcctcggaggacgactcgccgcccccgcggcccagccaccagcccgcgccccagtaggagccccgcggcccagcaggtgcggcgcgcacggagcgccccggccggcggcttctcccggaggccccggcgcccgcacccacccggcccggccccgagagcaggctcgaccgccgccccatggacccctcgcccaggccggggctggagggattcggccgcggctccggtcctgggcgcttcccttttaagcaagggcgcctcacctgctcttcaagaaacagcgagagggagacccagggggctgaaacttgaactctggttcttttaaaattaattttggttggtgttgggggaggcgcgagtgcgtgtgagaagaaccgacccaccccgcgcaaggggaagcctcctgtctcccctttccccgcgtccgagaaggcggaaacccacagtgttacctgacttatgaaacttgaaaccgcctctggagccgccattctgcagagtatttggaaaaagaaaaaagggtttatgcttacgtctctggggtcggggggattatgtcacgagcgttcaaactgctggaaatctcaaaactgtactgtctttatttttgtatattgtatttatatataaaaagaaacgtctacgtatgcatgctaaattattatttagcttctcccatcgcccacgatggaatgtaaaataa

SEQ ID NO: 18629 - DNA, 1620 bp, Homo sapiens
tctcttaacgggaaggggcagttggaggtgtgagactgagatctaatgattaacccgaaggctgcaggagaaggaagtcgccgggggaaggcgagccgagagcgccctgaattaggcaggcccgggaatgggggtcagggcttatcaccggggaaaggaacttgggccaggtcccccactggggcgttagagagacccgcggcccctccagggagagggagtgcttcaggagcagcaaacaagagaaatgggcttcggaggcccggggaggcaaggccaaggcccagggaacccccggctcttaccagggcgctgccctcctctggaagggcgttggatccggggtgcgatggccgaggcaggtggcctggcttgaaccagctatggggggactctcaacagtaggtgcctgccctggaatcctgggcgcccaacaagcccaggcgcagtcgaacctcctggggaagtgccgccggccgcgcaccgccttcaccagccagcagctgctggagctggagcaccagttcaagctcaacaagtacctgtcgcggcccaagcgcttcgaggtggccacctcgctcatgctcaccgagacccaggtgaagatttggttccagaaccggcggatgaaatggaaacgcagcaaaaaggccaaagagcaggcggcgcaggaagcggagaaacagaagggcggcggcgggggcgcggggaagggcggcgcggaggagccgggagccgaggagctgctggggccgccagcgcccggagacaagggcagcggacgccgcctgcgggacttgagggacagtgaccccgaggaggacgaggacgaggacgacgaggaccatttcccctacagcaacggcgccagcgtccacgccgcctcctccgactgctcctcggaggacgactcgccgcccccgcggcccagccaccagcccgcgccccagtaggagccccgcggcccagcaggtgcggcgcgcacggagcgccccggccggcggcttctcccggaggccccggcgcccgcacccacccggcccggccccgagagcaggctcgaccgccgccccatggacccctcgcccaggccggggctggagggattcggccgcggctccggtcctgggcgcttcccttttaagcaagggcgcctcacctgctcttcaagaaacagcgagagggagacccagggggctgaaacttgaactctggttcttttaaaattaattttggttggtgttgggggaggcgcgagtgcgtgtgagaagaaccgacccaccccgcgcaaggggaagcctcctgtctcccctttccccgcgtccgagaaggcggaaacccacagtgttacctgacttatgaaacttgaaaccgcctctggagccgccattctgcagagtatttggaaaaagaaaaaagggtttatgcttacgtctctggggtcggggggattatgtcacgagcgttcaaactgctggaaatctcaaaactgtactgtctttatttttgtatattgtatttatatataaaaagaaacgtctacgtatgcatgctaaattattatttagcttctcccatcgcccacgatggaatgtaaaataaattggttttgtactggat

SEQ ID NO: 18630 - DNA, 1847 bp, Homo sapiens
aggggataggacgaagaaaccgaagggaaagctcagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgc

SEQ ID NO: 18631 - DNA, 3383 bp, Homo sapiens
aggagggaagcctggtggggagaagggagcccgcaggatcaggggtcagagttagggggcttccctcctgctgcaccctcatctcagggccgccaacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaact

SEQ ID NO: 18632 - DNA, 4100 bp, Homo sapiens
gataggacgaagaaaccgaagggaaagctcagggccgccaacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagtcttgcctccagcaaatccatcctccaatcctgatgccagagtgatctgaaatgcaaatatgatcttgccactcccctgcttaaaacccaccaaccgcagtggttctgtaaccacagtgtagcctctgacgtgggctgaaagcacaaagccaggctatttgatctctggagaaggatcctttcccttcctgcttgggttccacctgcaccctatgacttcgggtggaaactgctgtctgatcagccaccttgcccacacacttggacatctgtactgtctctgatcccttctctcctcaccaacaggctggaccccacatccacccctctgaatcaaatcattccgcttccccttagcctcagctctttcttctgggttgtttgtattttcttttctgtcccaaacagtttcccccacaaaaagaactttatgtctttctctgtcttccctcagtccttccagtcagcagcctgtgattgggcttttcccctcagaaacgaacaatccagaacccactgtttaaaacaactgtattttgccttgggaagtcccattgccttccctgaaaacattaaacattcctccgatccccagcctgagtctctctgtctctgggccccatcctgctccacagcagggctggtgtgtccagcacagagtgaccctccgatgccctttcccacccgccgccctgcctccctcgagccctgccttccctcacttcccagtctcctctgcttctggcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatg

SEQ ID NO: 18633 - DNA, 3552 bp, Homo sapiens
gcttttcactgagtcccgaggctctggagggtgggcgtgagggtagccctggctgaggctcggaggtcctcccgggctgttcagagggccccaagcggtagccacgttctgatactggctagaagccaggggagggagcttggggtaaggggagggccctgagggaggggtcagacgctttaggaaagagttaatgcgaagagggggaggggataggacgaagaaaccgaagggaaagctcagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaa

SEQ ID NO: 18634 - DNA, 2965 bp, Homo sapiens
agtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggct

SEQ ID NO: 18635 - DNA, 3641 bp, Homo sapiens
cgctggatgagcttccccattccggccgcagccgacctagatcccagccctgccctttgctctcctgcttttcactgagtcccgaggctctggagggtgggcgtgagggtagccctggctgaggctcggaggtcctcccgggctgttcagagggccccaagcggtagccacgttctgatactggctagaagccaggggagggagcttggggtaaggggagggccctgagggaggggtcagacgctttaggaaagagttaatgcgaagagggggaggggataggacgaagaaaccgaagggaaagctcagggccgccaacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaagccttga

SEQ ID NO: 18636 - DNA, 275 bp, Homo sapiens
gggaggggataggacgaagaaaccgaagggaaagctcagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagtcttgcctccagcaaatccatcctccaatcctga

SEQ ID NO: 18637 - DNA, 3960 bp, Homo sapiens
attggtggcgggcggcgggagcggcgcgggcgcgtgcgggcggcggcagcggcggtgacggcagcctaggccgggcgagggccatgctgagcctcgcagccaagctggtggccttcttctggaggacggcggacacccctagggaggaagccgggcagctggagcccgagctcgcggaaggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcactttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctctgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgagacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgacccccagaa

SEQ ID NO: 18638 - DNA, 1701 bp, Homo sapiens
agacgctgcgtgcaaagcactgggtgctgatgtggcttagcatctcctgacacctgtggcctgtcctccctccagccgggtgacacccagacccccagctcctgcacacccctgggcaaccctgctgtgcccccggggtgctgagcgtggctttgccagtgtgtcagaggcatcaattgctaaaacaattcggcagaaattaccatttagaacatctttgctctagagttgggcacttcactcacgtgtttgtggacgaggctgggcaggcaagtgagccggaatgcctcattcctctggggctgatgtcggacatcagtggccaggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtacgccctgcccaggcacgcctggttctgtgaggtccctgcagccctgctccttggctcctgcagctccacagaggcaggaacaagctccttgtgagcagcagcaggtttttaaaggggcaggaccgcacttgaatgtcgttcaacatgagaggtcacccaactgccatccatgggccagttccgggcagctgccagcttttctacggccagagcctcgaacagtttttacatttctaaatggttacatttatatgtcccttgatatttggccctttgggaaaacatttgccaacccccagctctaacccagtgtttctcaaagggggcactttgggtatatttgaatgggacgcttctcatttcgtatgactctgtgatgtgattataggagagttagcgtccccaggccccaggggctggtcccaggaagcatctccacacgttcacagtggctctggagctctggtggggacacaggtgcctcccatgccgaacaccaggtttcattcatgaagcatgtgtccctgtggtgttcacaccaccaagcagaacttggaaagaacccccaaaatacagaagaaaaggtgagtcccctaggccatcacagtaacagatcacctgtaccgcgcgtgtgctgaccgcagagcccgtcaaagatgttatgtttccttttttctgacctcggggactcgagaggtgagtgcttagttctcccagaggtacagagattacgaaggcttatggagacaagtaagttgccagacatcacacagccagtgtcctggtgtcttaacctcagcttgtaggtgccatcctgctgagacatccagcttagagctgccatcctcagctctaagcatcagacatgcatctcgtttctcctgaaggatttcctccatccttgatatgtgcttgtggggagggaggattttccacatgaaacttggctttcctagtaagcattgtcccccgtccccagtttaactaaaactgcaatttgtgttctaatcaattcagattagaagaaagcaataaagaattaaaaaac

SEQ ID NO: 18639 - DNA, 3086 bp, Homo sapiens
ccatgctgagcctcgcagccaagctggtggccttcttctggaggacggcggacacccctagggaggaagccgggcagctggagcccgagctcgcggaaggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcactttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctctgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccaggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtacgccctgcccaggcacgcctggttctgtga

SEQ ID NO: 18640 - DNA, 1422 bp, Homo sapiens
gagagccgtgtgtggctaccggattggacagcacggatctgaacaagacagggattttttttgttaatgtgtgttgatgagtcaaaggtcaagagccgaagagccagtcctcactggggtgcagagggctctttgggggcagagcgggcactgcatggaccctgcaccctggagctgatgttcagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgagacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcga

SEQ ID NO: 18641 - DNA, 3763 bp, Homo sapiens
ggcagcctaggccgggcgagggccatgctgagcctcgcagccaagctggtggccttcttctggaggacggcggacacccctagggaggaagccgggcagctggagcccgagctcgcggaaggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcactttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctctgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgacccccagaa

SEQ ID NO: 18642 - DNA, 853 bp, Homo sapiens
ataggtctttgagtgcagtgcgggccggcaggcaacgctgggcccggcctttcctcatctccgctggcggggatccccgttcgcctcaggaggcttccgaccccacagcatcccgccgctctgggcgcccgtcctctgtgaggtctctccggtgacaccagcccctcttcccgccctcactttgtgtgtttacgccgagcagctgccaagtcgtctctccatgtcgttcctccctgtccgcagcgtcattggcggtggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtagcgtgccgactagtggctcctctctgtgcttctggcagacctgccatcaggggtaacttgcacggcccaggcttctcctgcatgtgttggaagcctggaaaaataaagctttgtcatggccaaagagaaaaaaaa

SEQ ID NO: 18643 - DNA, 3941 bp, Homo sapiens
ataggtctttgagtgcagtgcgggccggcaggcaacgctgggcccggcctttcctcatctccgctggcggggatccccgttcgcctcaggaggcttccgaccccacagcatcccgccgctctgggcgcccgtcctctgtgaggtctctccggtgacaccagcccctcttcccgccctcactttgtgtgtttacgccgagcagctgccaagtcgtctctccatgtcgttcctccctgtccgcagcgtcattggcggtggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcactttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctctgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgaccccc

SEQ ID NO: 18644 - DNA, 3889 bp, Homo sapiens
atgacgtcactcccaccaggcacctcgccttgtcaggagctgccaggcagcggcggtgacggcagcctaggccgggcgagggccatgctgagcctcgcagccaagctggtggccttcttctggaggacggcggacacccctagggaggaagccgggcagctggagcccgagctcgcggaaggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcactttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctctgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgagacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcata

SEQ ID NO: 18645 - DNA, 1103 bp, Homo sapiens
gcatgtgcggtgaggctcgcggccggagtgcggcgctgggcggaagctaccatggcggccgagcgaaagacaaggttgtccaagaatctactgcgcatgaagtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatatttattatgtcaagccaattcgtacatacaatttggaatcaaatgtcataagaatttattatataaatttatcaagaataaaaatgcctctccagccttaagtatttacatgctcccaggtcattgtcagtttatggtattatgttgttttatttaaagcattgaattgatagaaaaatttgctctgtaataaaaatctactttcacata

SEQ ID NO: 18646 - DNA, 4390 bp, Homo sapiens
gttacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctgacagggtctcgctctgttgtccaggctggagtgcagtggcgcggattacagctcactggagtcttgacttcccaggcacaagcaatcctcccacctcagcctcctaactacctgggactaaaaatgacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcgctcttgttgcccaggctggagtgcaatggtgcgatctcggctcactgcaagctctgcctcctgggttcaagtgattctcctgcctcagcctcctgagtagctgggattacagacacccgccatggcacccagctaattttgtatttttagtagagatggggtttatccatgttggtcaggctggtcttgaactcctgacctcaggtgatccgcccgcctcggcctcccaaagtgcttggattacaggcatgagccaccgcacccagcaagagttattttcttaacttgaaattttctactagccctggtgaacttctgtgcttaaaaaaaaaaaaaaaaaaaggaaaaattcagctctaaaacatttgcttacagcaagggagccatgttatattcaagttacccaagcaccaaataaagtgtgggtttgctgcccttgaaagggttgggaggcctgatctttttctagtagacagttgccacacattccccaagcacaaaaggtggagatggcagtcactttgtaaatatgctgtagtcacttatcatcttttcaaagggtaacaagagaatctaagatgtagtaagaatgtaaaccagtacactatgagacctaaaagagagtattaaatgtgaacttttagcagagcgtggtggctcacacctataatcccagcgctttggaggctgaggttggaggattgcttaagtccaggagttcaagaccagcctgggtaacatggggtggaacaagcctgtagtcccagatactcaggaggctgaggtgaaaggattgcttgagccagggaggtcaaggctgcagtgagccgtgaaaggccactgcactccagcctgagtgacagaatgagaccttgtctcaaaaaaaaaaaaaagtttcttggaacctatacggtttttttttgttttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttcctttt

SEQ ID NO: 18647 - DNA, 4217 bp, Homo sapiens
ggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcgctcttgttgcccaggctggagtgcaatggtgcgatctcggctcactgcaagctctgcctcctgggttcaagtgattctcctgcctcagcctcctgagtagctgggattacagacacccgccatggcacccagctaattttgtatttttagtagagatggggtttatccatgttggtcaggctggtcttgaactcctgacctcaggtgatccgcccgcctcggcctcccaaagtgcttggattacaggcatgagccaccgcacccagcaagagttattttcttaacttgaaattttctactagccctggtgaacttctgtgcttaaaaaaaaaaaaaaaaaaaggaaaaattcagctctaaaacatttgcttacagcaagggagccatgttatattcaagttacccaagcaccaaataaagtgtgggtttgctgcccttgaaagggttgggaggcctgatctttttctagtagacagttgccacacattccccaagcacaaaaggtggagatggcagtcactttgtaaatatgctgtagtcacttatcatcttttcaaagggtaacaagagaatctaagatgtagtaagaatgtaaaccagtacactatgagacctaaaagagagtattaaatgtgaacttttagcagagcgtggtggctcacacctataatcccagcgctttggaggctgaggttggaggattgcttaagtccaggagttcaagaccagcctgggtaacatggggtggaacaagcctgtagtcccagatactcaggaggctgaggtgaaaggattgcttgagccagggaggtcaaggctgcagtgagccgtgaaaggccactgcactccagcctgagtgacagaatgagaccttgtctcaaaaaaaaaaaaaagtttcttggaacctatacggtttttttttgttttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgtt

SEQ ID NO: 18648 - DNA, 2705 bp, Homo sapiens
gttacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctgacagggtctcgctctgttgtccaggctggagtgcagtggcgcggattacagctcactggagtcttgacttcccaggcacaagcaatcctcccacctcagcctcctaactacctgggactaaaaatgcacgccaccacatccggctaa

SEQ ID NO: 18649 - DNA, 2175 bp, Homo sapiens
gaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaaaaaaaaaaaaaaaaagtttcttggaacctatacgttttttttgttttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttg

SEQ ID NO: 18650 - DNA, 3194 bp, Homo sapiens
atatacaggaggagataaaaaatttagtcaaattacagactagtagtgcttccttagcttcctgtgaaggaaattcttcaaacaaacaagtatcttcggaaagtcaaatgggttttttttctctaagcagtgagagaaatgaatctgttatccattatcctgaatccacagaacctgaaatacagcaagaaatgtccacgtcacaaccagactgcaatgtggatagttgctcagtaagcagtggatatggcaccttttgtatctcagaattaaatctgtacaaatctaaagaccctaaggagttcatggagcacatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaacaaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcagacccctcagatatgtgaggaatcaagccataaatgtgcatttgctggacattatgtaccatgtcatctctatgactacagatttcaaggataa

SEQ ID NO: 18651 - DNA, 5799 bp, Homo sapiens
cagcatatacaggaggagataaaaaatttagtcaaattacagactagtagtgcttccttagcttcctgtgaaggaaattcttcaaacaaacaagtatcttcggaaagtcaaatgggttttttttctctaagcagtgagagaaatgaatctgttatccattatcctgaatccacagaacctgaaatacagcaagaaatgtccacgtcacaaccagactgcaatgtggatagttgctcagtaagcagtggatatggcaccttttgtatctcagaattaaatctgtacaaatctaaagaccctaaggagttcatggagcacatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaacaaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatggccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcgtatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggagggctctcagagtagctctctgcccattgttctgaattaacttgtgtcccaccctggacaataaatggacagataaaccctttgaaatacaagccaccaccccgtgagggattaagagggcagcctggttttcttagtgtgcatggcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctggtgccttcccctcggccttgcagagggctccagcccactgcctctgtggtagccgctggctctcagaagtagcacgtgggcaggagtctctcctctgatccaggagcattggcaggtttgtgttgggactgctggttaagttggagctgtgtaactacttagtttttggtagccaatcagaacgcagtgccccacatattccagctcggtacatgttgataaacagactcatccaaactttcaaaatggattcgtactaaacatgctcaggttttaaattttggtttgcttttgagcttttcctctttatgtggctcttaataataagtagttagaatgaaccaagccatcccagttattccaagcaggctctcaaatgacctttgagcacccttcacctggctggtccccaggccaggggtccacagccctgctcccttctcagcaaggagggtggcctgtctgacagtgcagttgaacctttgctccctactctgcaacttttgaagacttcaggctaatcaaaattacttataattagaatcaagtgcctttattcttgttttttatttttattttattttatttatttatttttttagatggagttttgcccttgttgcccaggctggagtgcaatggcatgatctcagctcactgcaacctctgcctcccgggttcaagcgattctcctgcctcagcctgctgggtagctgggattacaggcatctgccaccacgcccggctaattttgtgtgtgtgtatatgtctatgtgtgtgtgtgtatgtatatatcttttttttttttttagtagagatggtgtttcaccatattggccaggctggtctcaaactcctgaactcatgtgatccgcctgccttggcccctcaaagtgctgggattacaggcatgagccaccacacccggcctattcttggtattctttattcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaatgccatttcagaagagatgatagttttatcttgccaaggaattatcttcttagtagcctatattggcttattccaaaaaaggcgttaacctccatcaaaacatcttctgcgcctctctctcagcatatgctttgatatttgaagtgtgtaatagattggagctatcagtcacttatttctaaaaaatgtattcttttttcttcatagctgtgaagagggataccaaggaaagttctttctgctgtctttctcttcggtaatgcttatcttatgaacactcaactgaaaaaacactccacctaaaagcaggaaagatggcaattctaaatagcagctattatccccgggtataaactatttttgttgttggcttggggctttgctgcaggtattaatagtttaaaaagaaaaaaaaaaaaaaaa

SEQ ID NO: 18652 - DNA, 998 bp, Homo sapiens
gagggacggtgggggtgaccccctctcctcttggcttgacaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccggaa

SEQ ID NO: 18653 - DNA, 2011 bp, Homo sapiens
acagtgactatgatactgcctcctaagcaaggacacaccccagtgatgagaaataggcaaaccatggtcttgaaatgcctaggagtataggctggggtttggagggaaatagttggatgacctcaggaaatagaaaaaaacaggcagctgctttttggagagagtggagatgagatcagtgcctacctggaacaaaaccctctggcattctagactggctgaatatgtagtgtagggactttatcatctgtcagaaaatctcctttaagaagaagcgatcaagaagtttagtcctggccaggtgtggtggctcacgcctgtaatcccaacactttgggaggccaaggcaggcggattacttgaggtcagaagttcaagaccagcctggccaatgtatggtgaaaccccgtctctaccaaaaatgtaaaaaattagccaggtgtgatggcacacacctgcaatcccagctactcaggaggctgaggcagaagaatcatttgaacctgggatgcagaggttgcagtgagccgagatcctgccactgcactccagcctgggtgacggagcgagactccgtctcaaaaagagttcagcccctatcctgtacagatgagaaaatagacctggaggaaacccaagtctatcaacagcagagaccacaacccatgtcagtgcaaagaagccaagtgttgcactaccctattgggatccagctcacattgagccagttttgttttttgagctgttacgcaagtgccttctgtcgaagagaagctttactcaattctacagggcagcccccttcctattttcagtggtagaaaagatgagacctggggatccacacttgaggctgtagattggtgctggcagccctgcttctgcaactgagtctcagccctagtcttgaccttgttctttttctctaacaagccttttctctttctaaccctccctcccaatatacccacttcatactatccattgttcatacacttctctacctttattcctcttctcatattcctcccttcgccagagtgtctttttccaccatcttcacctgagttcaattcatccttcaaggtcccggctcaaattccaccttcaccaaagagcttcccagttttctccagtaaaaaatagtttccctcccttgtgttcccaagggggaagggaggaaaaaggataaacaagcattaagcacttgatccattttaggcacttcgcatgtgtcacttgtatgagggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgg

SEQ ID NO: 18654 - DNA, 1005 bp, Homo sapiens
gcggaagttcctaggccagcctgtcacgtgggagggaggctcggcgctcaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgg

SEQ ID NO: 18655 - DNA, 906 bp, Homo sapiens
caggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatgttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccggaa

SEQ ID NO: 18656 - DNA, 603 bp, Homo sapiens
gcggaagttcctaggccagcctgtcacgtgggagggaggctcggcgctcaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattccca

SEQ ID NO: 18657 - DNA, 859 bp, Homo sapiens
ctcggcgctcaggaagcatggcactctggcgggcataccagcgggccctggccgctcacccgtggaaagtacaggtcctgacagctgcccatcccaggagatgtcctgacaacacctgtgtaccctgcatagggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacc

SEQ ID NO: 18658 - DNA, 575 bp, Homo sapiens
ggagggaggctcggcgctcaggaagcatggcactctggcgggcataccagcgggccctggccgctcacccgtggaaagtacaggtcctgacagctggcctcctggactgaaggacacgcttcctgctcctcactccaagaagccacttcttgcccctctgccttctgcgcatgaaactcaaaagccacaaaagaatattgctgtctgccatccccacgagggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgca

SEQ ID NO: 18659 - DNA, 482 bp, Homo sapiens
ggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagc

SEQ ID NO: 18660 - DNA, 623 bp, Homo sapiens
ctgacagccaggggaagaagacaggttttacagggataaaaaagggggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccggaa

SEQ ID NO: 18661 - DNA, 1939 bp, Homo sapiens
gggcccggagccggcgagtgctcccgggaactctgcctgcgcggcggcagcgaccggaggccaggcccagcacgccggagctggcctgctggggaggggcgggaggcgcgcgcgggagggtccgcccggccagggccccgggcgctcgcagaggccggccgcgctcccagcccgcccggagcccatgcccggcggctggccagtgctgcggcagaagggggggcccggctctgcatggccccggctgctgacatgacttctttgccactcggtgtcaaagtggaggactccgccttcggcaagccggcggggggaggcgcgggccaggcccccagcgccgccgcggccacggcagccgccatgggcgcggacgaggagggggccaagcccaaagtgtccccttcgctcctgcccttcagcgtggaggcgctcatggccgaccacaggaagccgggggccaaggagagcgccctggcgccctccgagggcgtgcaggcggcgggtggctcggcgcagccactgggcgtcccgccggggtcgctgggagccccggacgcgccctcttcgccgcggccgctcggccatttctcggtggggggactcctcaagctgccagaagatgcgctcgtcaaagccgagagccccgagaagcccgagaggaccccgtggatgcagagcccccgcttctccccgccgccggccaggcggctgagccccccagcctgcaccctccgcaaacacaagacgaaccgtaagccgcggacgcccttcaccaccgcgcagctgctggcgctggagcgcaagttccgccagaagcagtacctgtccatcgccgagcgcgcggagttctccagctcgctcagcctcactgagacgcaggtgaagatatggttccagaaccgccgcgccaaggcaaagagactacaagaggcagagctggagaagctgaagatggccgccaagcccatgctgccaccggctgccttcggcctctccttccctctcggcggccccgcagctgtagcggccgcggcgggtgcctcgctctacggtgcctctggccccttccagcgcgccgcgctgcctgtggcgcccgtgggactctacacggcccatgtgggctacagcatgtaccacctgacatagagggtcccaggtcgcccacctgtgggccagccgattcctccagccctggtgctgtacccccgacgtgctcccctgctcggcaccgccagccgccttccctttaaccctcacactgctccagtttcacctctttgctccctgagttcactctccgaagtctgatccctgccaaaaagtggctggaagagtcccttagtactcttctagcatttagatctacactctcgagttaaagatggggaaactgagggcagagaggttaacagatttatctaaggtccccagcagaattgacagttgaacagagctagaggccatgtctcctgcatagcttttccctgtcctgacaccaggcaagaaaagcgcagagaaatcggtgtctgacgattttggaaatgagaacaatctcaaaaaaaaaaaaaaaaaaaaaaaaaaaaaaaaaaaagaaaagagaaaaaaaagactagccagccaggaagatgaatcctagcttcttccattggaaaatttaagacaagttcaacaacaaaacatttgctctggggggcagggaaaacacagatgtgttgcaaaggtaggttgaagggacctctctcttaccagtaccagaaacacaattgtaaaattaaaaaaaaaaaaaaactctttctatttaacagtacatttgtgtggctctcaaacatccctttggaagggattgtgtgtactatgtaatatactgtatatttgaaattttattatcatttatattatagctatatttgttaaataaattaattttaagctacaaaaa

SEQ ID NO: 18662 - DNA, 2489 bp, Homo sapiens
cttcccctcggaggaaaggctcagctcccagcgcgcccctcccgtctccgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcggaggagcgccgcgtcaaggtctccagcctgcccttcagcgtggaggcgctcatgtccgacaagaagccgcccaaggaggcgtccccgctgccggccgaaagcgcctcggccggggccaccctgcggccactgctgctgtcggggcacggcgctcgggaagcgcacagccccgggccgctggtgaagcccttcgagaccgcctcggtcaagtcggaaaattcagaagatggagcggcgtggatgcaggaacccggccgatattcgccgccgccaagacatatgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggccaaggcgaaaagactgcaggaggcagaactggaaaagctgaaaatggctgcaaaacctatgctgccctccagcttcagtctccctttccccatcagctcgcccctgcaggcagcgtccatatatggagcatcctacccgttccatagacctgtgcttcccatcccgcctgtgggactctatgccacgccagtgggatatggcatgtaccacctgtcctaaggaagaccagatcaatagactccatgatggatgcttgtttcaaagggtttcctctccctctccacgaaggcagtaccagccagtactcctgctctgctaaccctgcgtgcaccaccctaagcggctaggctgacagggccacacgacatagctgaaatttgttctgtaggcggaggcaccaagccctgttttcttggtgtaatcttccagatgcccccttttcctttcacaaagattggctctgatggtttttatgtataaatatatatatataataaaatataatacatttttatacagcagacgtaaaaattcaaattattttaaaaggcaaaatttatatacatatgtgctttttttctatatctcaccttcccaaaagacactgtgtaagtccatttgttgtattttcttaaagagggagacaaattatttgcaaaatgtgctaaagtcaatgatttttacgggattattgacttctgcttatggaaaacaaagaaacagacacaatgcacacagaaaatattagatatggagagattattcaaagtgaaggggacacatcatatttctgcattttacttgcattaaaagaaacctctttatatactacagttgttcctatctctcccccgccccccaccgccccaccacacacatatttttaaagtttttccttttttaagaatatttttgtaagaccaatacctgggatgagaagaatcctgagactgcctggaggtgaggtagaaaattagaaatacttcctaattcttctcaaggctgttggtaactttatttcagataattggagagtaaaatgttaaaacctgttgagaggaattgatggtttctgagaaatactaggtacattcatcctcacagattgcaaaggtgatttgggtgggggtttagtaattttctgcttaaaaaatgagtatcttgtaaccattacctatatgctaaatattcttgaacaattagtagatccagaaagaaaaaaaaatatgctttctctgtgtgtgtacctgttgtatgtcctaaacttattagaaaattttatatacttttttacatgttggggggcagaaggtaaagccatgttttgacttggtgaaaatgggattgtcaaacagcccattaagttccctggtatttcaccttcctgtccatctgtcccctccctccggtatacctttatccctttgaaagggtgcttgtacaatttgatatattttattgaagagttatctcttattctgaattaaattaagcatttgttttattgcagtaaagtttgtccaaactcacaattattttaagaggtgttctctgttcttagctgggcttagctcgaaagtgctacccacatgagggggaagctggtcttttttaatattttaatgtaagtcaaccaagagttgtggccagattcagccatgttggggtgattggtggtggtggggagtgaactgaaactactgaaatactttgaaatgtttcctctggcagcttgttacttatggaaaagaggtggaattgctgcgaggagtttttc

SEQ ID NO: 18663 - DNA, 1861 bp, Homo sapiens
gtagtgggtcagggagggcaccggaacagcgcgacccgacagcccgggaaacggacagccgtgtcagaagggcaggtgccagtgggcaggaggccggagagaaagccgcagcttccttccacctcgcgccgggcccgcggccgcgcacggggaccgctccgagttcctcccggcgggaaccccccgccccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgc

SEQ ID NO: 18664 - DNA, 1870 bp, Homo sapiens
gacagcccgggaaacggacagccgtgtcagaagggcaggtgccagtgggcaggaggccggagagaaagccgcagcttccttccacctcgcgccgggcccgcggccgcgcacggggaccgctccgagttcctcccggcgggaaccccccgccccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcagatgttgctcgggaa

SEQ ID NO: 18665 - DNA, 1720 bp, Homo sapiens
gtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactggtgagccccgccctggcctcccccatccctggcccccggcgctggcctccagagccagcccacctcggctgcagcttcccctctgctggggccgcctgcttggcctgcacctgcgctcttagccctgcacaatctccccctccagcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 18666 - DNA, 1432 bp, Homo sapiens
atggagcacgcgccctggagccccggagccagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgc

SEQ ID NO: 18667 - DNA, 1832 bp, Homo sapiens
gtgtcagaagggcaggtgccagtgggcaggaggccggagagaaagccgcagcttccttccacctcgcgccgggcccgcggccgcgcacggggaccgctccgagttcctcccggcgggaaccccccgccccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 18668 - DNA, 1691 bp, Homo sapiens
cgcagcccgcccctgcggcagagtggcgcccgcgcgtgactcccccctgccggctgcggaggtgggggggggacggcgcccccgccgtgtgcgtggggcggggatggagcacgcgccctggagccccggagccagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 18669 - DNA, 3074 bp, Homo sapiens
cgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaattttgcatctgtgactcagccacagaaacagccagcttggaaaactgggacgtacaaaggaaaaccacaagtttctatttctatcactgaaaaggtaaaatccatgcaatatgataaacagggtatagcagatacatggcaagttgttggaacagtgacttgcaagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagtttaaagaaaatcataatcttatatttttaatgtggatgcatataacctgtgagtgaaaaatcactgaatgatttaattgtaaaagtagtcttatgtggtgtttgtagtctgatagagcttgaaaggacattttaaaagctaatgtctccaattttgttaaccttcgattttatgccagtataattcagaacatagaaaagtaatgattcacttgggctcattttagactggtcctgggtcaccctgccacacttgtttcctagtgtttctgtggcagacattgctaatcaattacagcccttttctgtactgagccttggataaagggtcaggctcctttttagttcagagattcaggcagccactcccagtgggttgtagataatgtgcaagataaaaactattttctcttccaaatctaagtactaagctcctagtataaggtgttgttacagaataccagagaccatgttagagacaactacatctcttcaaaaaacagccaacagagacaaaggaaaagtgtttaaatagtaagctgttcttcttaatcagaactatcctattgactaataaataatctgcataattctacttaaggtgtgtaatctctgttctagagttagtttttaagtaagcttgttaatctgccactttgacattttgcttaggatgtcagtagccatattaagatgtgtagaataccttcagaagatgatcatagtgttttgtaatcatttaatgtctgcagccaaatttttaaaggtaatttagacctaatactgctcttgctgtgtcttattaagttaaaattaatgaatgaattctggtaaaaattcaaaaggcactctgtgagtagagagtatcatttaagcttattttagtcacatgtagtatatatctccttaaagctgtcactctcactttcttaccattctcttgatttcttcagaaaccatctagtcatcatctttatactctacctgcttctgcaattatatatcatattatgttttcagagcagttcattgtcaagttggactttaagtgaccattcaagaaaagatgaaatctcacgaacctcaaaacttcattcatgtctttttacaaatgagaaaaaaaaatgcattaaagattaatactcaatttgattata

SEQ ID NO: 18670 - DNA, 16737 bp, Homo sapiens
atgctggtgatctggattctgacgctggctctccggctctgcgcgtccgttactacagtgacaccagagggctctgctgttcacaaagccatttcccagcagggcacattgtggactggtgaggttttggagaagcagacagtcgagcaagggaagagcactctgagaaggcagaaaaatcatttccacaggtctgcaggggagctacggtgcaggaatgccctgaaagatgagggggcatctgctggatggagcgtgatgtttgctggggagagtgtggtggtgctggtgcatttgtggatgacaggagcacgagtgaagaacctgggcttggtggagtttgctagcccaggggacgacggggatggcagagccgagggctttagcctggggctcccacttagtgagcaggcaagggctgcaggagccagagagaaggagcgtcaggagacagtcataaatcatagcactttctctggtttctctcaaatcacaggctcaacagtaaacaccagtattggaggtaatacaacttctgcatccacacccagttcaagcgacccttttaccacctttagtgactatggggtgtcagtcacatttatcacgggctcaactgcaacaaaacacttccttgacagctccacaaactcaggccacagtgaggaatcaacagtatcccacagcggcccaggtgcaactggaacaacactcttcccttcccactctgcaacctcagtttttgttggagaacctaaaacctcacccatcacttcagcctcaatggaaacaacagcgttacctggcagtaccacaacagcaggcctgagtgagaaatctaccaccttctacagtagccccagatcaccagacagaacactctcacctgcccgcacgacaagctcaggcgtcagtgaaaaatcaaccacctcccacagccgaccaggcccaacgcacacaatagcgttccctgacagtaccaccatgccaggcgtcagtcaggaatctacagcttcccacagcatccccggctccacagacacaacactgtcccctggcactaccacaccatcatcccttggtccagaatctactaccttccacagcagcccaggctacactaaaacaacacgcttacctgacaacaccacaacctcaggcctccttgaagcatctacgcccgtccacagcagcactggatcgccacacacaacactgtccccttccagctctacaacccatgagggagaacctaccaccttccagagctggccaagctcaaaggacacttcgcctgcaccttctggtaccacatcagcctttgttaaactatctacaacttatcacagcagcccgagctcaactccaacaacccacttttctgccagctccacaaccttgggccatagtgaggaatcgacaccagtccacagcagcccagttgcaactgcaacaacacccccacctgcccgctccgcgacctcaggccatgttgaagaatctacagcctaccacaggagcccgggctcaactcaaacaatgcacttccctgaaagctccacaacttcaggccatagtgaagaatcagcaactttccacggcagcacaacacacacaaaatcttcaactcctagcaccacagctgccctagcacatacaagctaccacagcagcctgggctcaactgaaacaacacacttccgtgatagctccacaatctcaggccgtagtgaggaatcaaaagcatcccacagcagcccagatgcaatggcaacaacagtcttacctgccggctctacaccctcagttcttgttggagactcgacgccctcacccatcagttcaggctcaatggaaaccacagcgttacccggcagtaccacaaaaccaggcctcagtgagaaatctaccactttctacagtagccccagatcaccagacacaacacacttacctgccagcatgacaagctcaggcgtcagtgaagaatccaccacctcccacagccgaccaggctcaacacacacaacagcattccctggcagtaccaccatgccaggcctcagtcaggaatctacagcttcccacagcagcccaggccccacagacacaacattgtcccctggcagtaccacagcatcatcccttggtccagaatatactaccttccacagccgcccaggctccactgaaacaacactcttacctgacaacaccacagcctcaggactccttgaagcatctatgcccgtccacagcagcaccagatcgccacacacaacactgtcccctgccggctctacaacccgtcagggagaatctaccacattccatagctggccaagctcaaaggacactaggcctgcacctcctactaccacatcagcctttgttgagccatctacaacctcccacggcagcccgagctcaattccaacaacccacatttctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcgcacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagagatctaccactttccatagtagccccagatcaccagccacaacactctcacctgccagcacgacaagctcaggcgtcagtgaagaatccaccacctcccgcagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagctcaggttcaactgacacagcactgtcccctggcagtaccacagccttatcctttggtcaagaatctacaaccttccacagcaacccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctactgccttccagacccacccagcctcaactcacacaacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctgggcgtcggtgaagaatccaccacctcccgtagccaaccaggttctactcactcaacagtgtcacctgccagcaccaccacgccaggcctcagtgaggaatctaccaccgtctacagcagcagccgaggctcaactgaaaccacagtgttccctcacagcaccacaacctcagttcatggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaaaactctcacctgcccgctccaccacctctggcctcgttggagaatccacaccctcacgcctcagtccaagctcaaccgaaacaacaactttacctggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcattccctgacagcaccaccacctcagacctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacattgtcccctggcagtaccacagcatcatcccttggtccagaatctactactttccacagcagcccaggctccactgaaacaacactcttacctgacaacaccacagcctcaggcctccttgaagcatctacgcccgtccacagcagcactggatcgccacacacaacactgtcccctgccggctctacaacacgtcagggagaatctaccaccttccagagctggccaagctcaaaggacactatgcctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacggcgtaccacagcagcccgggctcaactcaaacaatgcacttccctgaaagctccacagcttcaggtcgtagtgaagaatcaagaacttcccacagcagcacaacacacacaatatcttcacctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacgctcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcacccccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagtgaagaatccagcacatcccacagtcaaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccaccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagtgaagaatccagcacatcccacagtcaaccaggctcaacgcacacaacagcgttccctgacagcaccaccacctcaggcctcagtcaggaacctacagcttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggcctaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggctccagtcaggaatcaacaacttcccacagcagctcaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtcgtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaaaactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcactggccttcaggaagaatctaccactttccagagctggccaagctcaagtgacacaacaccttcacctcccagcaccacagcagtccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactttcacctgccagcacgacaagctcaggcgtcagtgaagaatccaccacctcccacagccgaccaggctcaatgcacacaacagcattccctagcagtaccaccatgccaggcgtcagtcaggaatctacagcttcccacagcagcccaggctccacagacacaacactgtcccctggcagtaccacagcatcatcccttggtccagaatctactaccttccacagcagcccaggctccactgaaacaacactcttacctgacaacaccacagcctcaggcctccttgaagcatctacacccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaacattgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcaacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacggcgtaccacagcagcccgggctcaactcaaacaatgcacttccctgaaagctccacagcttcaggtcgtagtgaagaatcaagaacttcccacagcagcacaacacacacaatatcttcacctcctagcaccacatctgcccttgttgaagaacctaccagctaccacagcagcccgggctcaattgcaacaacacactttcctgagagctccacaacctccggccgtagtgaggaatcaacagcatcccacagcagcccagatacaaatggaatcacacccttacctgcccattttactacctcaggccgcattgcagaatctaccaccttctatatctctccaggctcaatggaaacaacattagccagcactgccacaacaccaggcctcagtgcaaaatctaccatcctttacagtagctccagatcaccagaccaaacactctcacctgccagcatgacaagctccagcatcagtggagaacccaccagcttgtatagccaagcagagtcaacacacacaacagcgttccctgccagcaccaccacctcaggcctcagtcaggaatcaacaactttccacagtaagccaggctcaactgagacaacactgtcccctggcagcatcacaacttcatcttttgctcaagaatttaccacccctcatagccaaccaggctcagctctgtcaacagtgtcacctgccagcaccacagtgccaggccttagtgaggaatctaccaccttctacagcagcccaggctcaactgaaaccacagcgttttctcacagcaacacaatgtccattcatagtcaacaatctacacccttccctgacagcccaggcttcactcacacagtgttacctgccaccctcacaaccacagacattggtcaggaatcaacagccttccacagcagctcagacgcaactggaacaacacccttacctgcccgctccacagcctcagaccttgttggagaacctacaactttctacatcagcccatcccctacttacacaacactctttcctgcgagttccagcacatcaggcctcactgaggaatctaccaccttccacaccagtccaagcttcacttctacaattgtgtctactgaaagcctggaaaccttagcaccagggttgtgccaggaaggacaaatttggaatggaaaacaatgcgtctgtccccaaggctacgttggttaccagtgcttgtcccctctggaatccttccctgtagaaaccccggaaaaactcaacgccactttaggtatgacagtgaaagtgacttacagaaatttcacagaaaagatgaatgacgcatcctcccaggaataccagaacttcagtaccctcttcaagaatcggatggatgtcgttttgaagggcgacaatcttcctcagtatagaggggtgaacattcggagattgctcaacggtagcatcgtggtcaagaacgatgtcatcctggaggcagactacactttagagtatgaggaactgtttgaaaacctggcagagattgtaaaggccaagattatgaatgaaactagaacaactcttcttgatcctgattcctgcagaaaggccatactgtgctatagtgaagaggacactttcgtggattcatcggtgactccgggctttgacttccaggagcaatgcacccagaaggctgccgaaggatatacccagttctactatgtggatgtcttggatgggaagctggcctgtgtgaacaagtgcaccaaaggaacgaagtcgcaaatgaactgtaacctgggcacatgtcagctgcaacgcagtggcccccgctgcctgtgcccaaatacgaacacacactggtactggggagagacctgtgaattcaacatcgccaagagcctcgtgtatgggatcgtgggggctgtgatggcggtgctgctgctcgcattgatcatcctaatcatcttattcagcctatcccagagaaaacggcacagggaacagtatgatgtgcctcaagagtggcgaaaggaaggcacccctggcatcttccagaagacggccatctgggaagaccagaatctgagggagagcagattcggccttgagaacgcctacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgctctgagctgacagacttggccagtcccctgcctgtgctcctgctggggaaggctgggggctgtaagcctctccatccgggagcttccagactcccagaagcctcggcacccctgtctcctcctgggtggctccccactctggaatttccctaccaataaaagcaaatctgaaagctca

SEQ ID NO: 18671 - DNA, 16321 bp, Homo sapiens
atgctggtgatctggattctgacgctggctctccggctctgcgcgtccgttactacagtgacaccaggctcaacagtaaacaccagtattggaggtaatacaacttctgcatccacacccagttcaagcgacccttttaccacctttagtgactatggggtgtcagtcacatttatcacgggctcaactgcaacaaaacacttccttgacagctccacaaactcaggccacagtgaggaatcaacagtatcccacagcggcccaggtgcaactggaacaacactcttcccttcccactctgcaacctcagtttttgttggagaacctaaaacctcacccatcacttcagcctcaatggaaacaacagcgttacctggcagtaccacaacagcaggcctgagtgagaaatctaccaccttctacagtagccccagatcaccagacagaacactctcacctgcccgcacgacaagctcaggcgtcagtgaaaaatcaaccacctcccacagccgaccaggcccaacgcacacaatagcgttccctgacagtaccaccatgccaggcgtcagtcaggaatctacagcttcccacagcatccccggctccacagacacaacactgtcccctggcactaccacaccatcatcccttggtccagaatctactaccttccacagcagcccaggctacactaaaacaacacgcttacctgacaacaccacaacctcaggcctccttgaagcatctacgcccgtccacagcagcactggatcgccacacacaacactgtccccttccagctctacaacccatgagggagaacctaccaccttccagagctggccaagctcaaaggacacttcgcctgcaccttctggtaccacatcagcctttgttaaactatctacaacttatcacagcagcccgagctcaactccaacaacccacttttctgccagctccacaaccttgggccatagtgaggaatcgacaccagtccacagcagcccagttgcaactgcaacaacacccccacctgcccgctccgcgacctcaggccatgttgaagaatctacagcctaccacaggagcccgggctcaactcaaacaatgcacttccctgaaagctccacaacttcaggccatagtgaagaatcagcaactttccacggcagcacaacacacacaaaatcttcaactcctagcaccacagctgccctagcacatacaagctaccacagcagcctgggctcaactgaaacaacacacttccgtgatagctccacaatctcaggccgtagtgaggaatcaaaagcatcccacagcagcccagatgcaatggcaacaacagtcttacctgccggctctacaccctcagttcttgttggagactcgacgccctcacccatcagttcaggctcaatggaaaccacagcgttacccggcagtaccacaaaaccaggcctcagtgagaaatctaccactttctacagtagccccagatcaccagacacaacacacttacctgccagcatgacaagctcaggcgtcagtgaagaatccaccacctcccacagccgaccaggctcaacacacacaacagcattccctggcagtaccaccatgccaggcctcagtcaggaatctacagcttcccacagcagcccaggccccacagacacaacattgtcccctggcagtaccacagcatcatcccttggtccagaatatactaccttccacagccgcccaggctccactgaaacaacactcttacctgacaacaccacagcctcaggactccttgaagcatctatgcccgtccacagcagcaccagatcgccacacacaacactgtcccctgccggctctacaacccgtcagggagaatctaccacattccatagctggccaagctcaaaggacactaggcctgcacctcctactaccacatcagcctttgttgagccatctacaacctcccacggcagcccgagctcaattccaacaacccacatttctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcgcacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagagatctaccactttccatagtagccccagatcaccagccacaacactctcacctgccagcacgacaagctcaggcgtcagtgaagaatccaccacctcccgcagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagctcaggttcaactgacacagcactgtcccctggcagtaccacagccttatcctttggtcaagaatctacaaccttccacagcaacccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctactgccttccagacccacccagcctcaactcacacaacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctgggcgtcggtgaagaatccaccacctcccgtagccaaccaggttctactcactcaacagtgtcacctgccagcaccaccacgccaggcctcagtgaggaatctaccaccgtctacagcagcagccgaggctcaactgaaaccacagtgttccctcacagcaccacaacctcagttcatggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaaaactctcacctgcccgctccaccacctctggcctcgttggagaatccacaccctcacgcctcagtccaagctcaaccgaaacaacaactttacctggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcattccctgacagcaccaccacctcagacctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacattgtcccctggcagtaccacagcatcatcccttggtccagaatctactactttccacagcagcccaggctccactgaaacaacactcttacctgacaacaccacagcctcaggcctccttgaagcatctacgcccgtccacagcagcactggatcgccacacacaacactgtcccctgccggctctacaacacgtcagggagaatctaccaccttccagagctggccaagctcaaaggacactatgcctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacggcgtaccacagcagcccgggctcaactcaaacaatgcacttccctgaaagctccacagcttcaggtcgtagtgaagaatcaagaacttcccacagcagcacaacacacacaatatcttcacctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacgctcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcacccccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagtgaagaatccagcacatcccacagtcaaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccaccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagtgaagaatccagcacatcccacagtcaaccaggctcaacgcacacaacagcgttccctgacagcaccaccacctcaggcctcagtcaggaacctacagcttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggcctaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggctccagtcaggaatcaacaacttcccacagcagctcaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtcgtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaaaactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcactggccttcaggaagaatctaccactttccagagctggccaagctcaagtgacacaacaccttcacctcccagcaccacagcagtccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactttcacctgccagcacgacaagctcaggcgtcagtgaagaatccaccacctcccacagccgaccaggctcaatgcacacaacagcattccctagcagtaccaccatgccaggcgtcagtcaggaatctacagcttcccacagcagcccaggctccacagacacaacactgtcccctggcagtaccacagcatcatcccttggtccagaatctactaccttccacagcagcccaggctccactgaaacaacactcttacctgacaacaccacagcctcaggcctccttgaagcatctacacccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaacattgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcaacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacggcgtaccacagcagcccgggctcaactcaaacaatgcacttccctgaaagctccacagcttcaggtcgtagtgaagaatcaagaacttcccacagcagcacaacacacacaatatcttcacctcctagcaccacatctgcccttgttgaagaacctaccagctaccacagcagcccgggctcaattgcaacaacacactttcctgagagctccacaacctccggccgtagtgaggaatcaacagcatcccacagcagcccagatacaaatggaatcacacccttacctgcccattttactacctcaggccgcattgcagaatctaccaccttctatatctctccaggctcaatggaaacaacattagccagcactgccacaacaccaggcctcagtgcaaaatctaccatcctttacagtagctccagatcaccagaccaaacactctcacctgccagcatgacaagctccagcatcagtggagaacccaccagcttgtatagccaagcagagtcaacacacacaacagcgttccctgccagcaccaccacctcaggcctcagtcaggaatcaacaactttccacagtaagccaggctcaactgagacaacactgtcccctggcagcatcacaacttcatcttttgctcaagaatttaccacccctcatagccaaccaggctcagctctgtcaacagtgtcacctgccagcaccacagtgccaggccttagtgaggaatctaccaccttctacagcagcccaggctcaactgaaaccacagcgttttctcacagcaacacaatgtccattcatagtcaacaatctacacccttccctgacagcccaggcttcactcacacagtgttacctgccaccctcacaaccacagacattggtcaggaatcaacagccttccacagcagctcagacgcaactggaacaacacccttacctgcccgctccacagcctcagaccttgttggagaacctacaactttctacatcagcccatcccctacttacacaacactctttcctgcgagttccagcacatcaggcctcactgaggaatctaccaccttccacaccagtccaagcttcacttctacaattgtgtctactgaaagcctggaaaccttagcaccagggttgtgccaggaaggacaaatttggaatggaaaacaatgcgtctgtccccaaggctacgttggttaccagtgcttgtcccctctggaatccttccctgtagaaaccccggaaaaactcaacgccactttaggtatgacagtgaaagtgacttacagaaatttcacagaaaagatgaatgacgcatcctcccaggaataccagaacttcagtaccctcttcaagaatcggatggatgtcgttttgaagggcgacaatcttcctcagtatagaggggtgaacattcggagattgctcaacggtagcatcgtggtcaagaacgatgtcatcctggaggcagactacactttagagtatgaggaactgtttgaaaacctggcagagattgtaaaggccaagattatgaatgaaactagaacaactcttcttgatcctgattcctgcagaaaggccatactgtgctatagtgaagaggacactttcgtggattcatcggtgactccgggctttgacttccaggagcaatgcacccagaaggctgccgaaggatatacccagttctactatgtggatgtcttggatgggaagctggcctgtgtgaacaagtgcaccaaaggaacgaagtcgcaaatgaactgtaacctgggcacatgtcagctgcaacgcagtggcccccgctgcctgtgcccaaatacgaacacacactggtactggggagagacctgtgaattcaacatcgccaagagcctcgtgtatgggatcgtgggggctgtgatggcggtgctgctgctcgcattgatcatcctaatcatcttattcagcctatcccagagaaaacggcacagggaacagtatgatgtgcctcaagagtggcgaaaggaaggcacccctggcatcttccagaagacggccatctgggaagaccagaatctgagggagagcagattcggccttgagaacgcctacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgctctgagctgacagacttggccagtcccctgcctgtgctcctgctggggaaggctgggggctgtaagcctctccatccgggagcttccagactcccagaagcctcggcacccctgtctcctcctgggtggctccccactctggaatttccctaccaataaaagcaaatctgaaagctcagaatgagaagtga

SEQ ID NO: 18672 - DNA, 2876 bp, Homo sapiens
atcatttcctcctcagattaccaagcaagaacagctaaaatgaaagccatcattcatcttactcttcttgctctcctttctgtaaacacagccaccaaccaaggcaactcagctgatgctgtaacaaccacagaaactgcgactagtggtcctacagtagctgcagctgataccactgaaactaatttccctgaaactgctagcaccacagcaaatacacctttcccaacagctacttcacctgctccccccataattagtacacatagttcctccacaattcctacacctgctccccccataattagtacacatagttcctccacaattcctatacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtg

SEQ ID NO: 18673 - DNA, 14241 bp, Homo sapiens
tctgaggctcatttcgccagctcctctgggggtgacaggcaagtgagacgtgctcagagctccgatgccaaggccagggaccatggcgctgtgtctgctgaccttggtcctctcgctcttgcccccacaagctgctgcagaacaggacctcagtgtgaacagggctgtgtgggatggaggagggtgcatctcccaaggggacgtcttgaaccgtcagtgccagcagctgtctcagcacgttaggacaggttctgcggcaaacaccgccacaggtacaacatctacaaatgtcgtggagccaagaatgtatttgagttgcagcaccaaccctgagatgacctcgattgagtccagtgtgacttcagacactcctggtgtctccagtaccaggatgacaccaacagaatccagaacaacttcagaatctaccagtgacagcaccacacttttccccagttctactgaagacacttcatctcctacaactcctgaaggcaccgacgtgcccatgtcaacaccaagtgaagaaagcatttcatcaacaatggcttttgtcagcactgcacctcttcccagttttgaggcctacacatctttaacatataaggttgatatgagcacacctctgaccacttctactcaggcaagttcatctcctactactcctgaaagcaccaccatacccaaatcaactaacagtgaaggaagcactccattaacaagtatgcctgccagcaccatgaaggtggccagttcagaggctatcacccttttgacaactcctgttgaaatcagcacacctgtgaccatttctgctcaagccagttcatctcctacaactgctgaaggtcccagcctgtcaaactcagctcctagtggaggaagcactccattaacaagaatgcctctcagcgtgatgctggtggtcagttctgaggctagcaccctttcaacaactcctgctgccaccaacattcctgtgatcacttctactgaagccagttcatctcctacaacggctgaaggcaccagcataccaacctcaacttatactgaaggaagcactccattaacaagtacgcctgccagcaccatgccggttgccacttctgaaatgagcacactttcaataactcctgttgacaccagcacacttgtgaccacttctactgaacccagttcacttcctacaactgctgaagctaccagcatgctaacctcaactcttagtgaaggaagcactccattaacaaatatgcctgtcagcaccatattggtggccagttctgaggctagcaccacttcaacaattcctgttgactccaaaacttttgtgaccactgctagtgaagccagctcatctcccacaactgctgaagataccagcattgcaacctcaactcctagtgaaggaagcactccattaacaagtatgcctgtcagcaccactccagtggccagttctgaggctagcaacctttcaacaactcctgttgactccaaaactcaggtgaccacttctactgaagccagttcatctcctccaactgctgaagttaacagcatgccaacctcaactcctagtgaaggaagcactccattaacaagtatgtctgtcagcaccatgccggtggccagttctgaggctagcaccctttcaacaactcctgttgacaccagcacacctgtgaccacttctagtgaagccagttcatcttctacaactcctgaaggtaccagcataccaacctcaactcctagtgaaggaagcactccattaacaaacatgcctgtcagcaccaggctggtggtcagttctgaggctagcaccacttcaacaactcctgctgactccaacacttttgtgaccacttctagtgaagctagttcatcttctacaactgctgaaggtaccagcatgccaacctcaacttacagtgaaagaggcactacaataacaagtatgtctgtcagcaccacactggtggccagttctgaggctagcaccctttcaacaactcctgttgactccaacactcctgtgaccacttcaactgaagccacttcatcttctacaactgcggaaggtaccagcatgccaacctcaacttatactgaaggaagcactccattaacaagtatgcctgtcaacaccacactggtggccagttctgaggctagcaccctttcaacaactcctgttgacaccagcacacctgtgaccacttcaactgaagccagttcctctcctacaactgctgatggtgccagtatgccaacctcaactcctagtgaaggaagcactccattaacaagtatgcctgtcagcaaaacgctgttgaccagttctgaggctagcaccctttcaacaactcctcttgacacaagcacacatatcaccacttctactgaagccagttgctctcctacaaccactgaaggtaccagcatgccaatctcaactcctagtgaaggaagtcctttattaacaagtatacctgtcagcatcacaccggtgaccagtcctgaggctagcaccctttcaacaactcctgttgactccaacagtcctgtgaccacttctactgaagtcagttcatctcctacacctgctgaaggtaccagcatgccaacctcaacttatagtgaaggaagaactcctttaacaagtatgcctgtcagcaccacactggtggccacttctgcaatcagcaccctttcaacaactcctgttgacaccagcacacctgtgaccaattctactgaagcccgttcgtctcctacaacttctgaaggtaccagcatgccaacctcaactcctggggaaggaagcactccattaacaagtatgcctgacagcaccacgccggtagtcagttctgaggctagaacactttcagcaactcctgttgacaccagcacacctgtgaccacttctactgaagccacttcatctcctacaactgctgaaggtaccagcataccaacctcgactcctagtgaaggaacgactccattaacaagcacacctgtcagccacacgctggtggccaattctgaggctagcaccctttcaacaactcctgttgactccaacactcctttgaccacttctactgaagccagttcacctcctcccactgctgaaggtaccagcatgccaacctcaactcctagtgaaggaagcactccattaacacgtatgcctgtcagcaccacaatggtggccagttctgaaacgagcacactttcaacaactcctgctgacaccagcacacctgtgaccacttattctcaagccagttcatcttctacaactgctgacggtaccagcatgccaacctcaacttatagtgaaggaagcactccactaacaagtgtgcctgtcagcaccaggctggtggtcagttctgaggctagcaccctttccacaactcctgtcgacaccagcatacctgtcaccacttctactgaagccagttcatctcctacaactgctgaaggtaccagcataccaacctcacctcccagtgaaggaaccactccgttagcaagtatgcctgtcagcaccacgctggtggtcagttctgaggctaacaccctttcaacaactcctgtggactccaaaactcaggtggccacttctactgaagccagttcacctcctccaactgctgaagttaccagcatgccaacctcaactcctggagaaagaagcactccattaacaagtatgcctgtcagacacacgccagtggccagttctgaggctagcaccctttcaacatctcccgttgacaccagcacacctgtgaccacttctgctgaaaccagttcctctcctacaaccgctgaaggtaccagcttgccaacctcaactactagtgaaggaagtactctattaacaagtatacctgtcagcaccacgctggtgaccagtcctgaggctagcacccttttaacaactcctgttgacactaaaggtcctgtggtcacttctaatgaagtcagttcatctcctacacctgctgaaggtaccagcatgccaacctcaacttatagtgaaggaagaactcctttaacaagtatacctgtcaacaccacactggtggccagttctgcaatcagcatcctttcaacaactcctgttgacaacagcacacctgtgaccacttctactgaagcctgttcatctcctacaacttctgaaggtaccagcatgccaaactcaaatcctagtgaaggaaccactccgttaacaagtatacctgtcagcaccacgccggtagtcagttctgaggctagcaccctttcagcaactcctgttgacaccagcacccctgggaccacttctgctgaagccacttcatctcctacaactgctgaaggtatcagcataccaacctcaactcctagtgaaggaaagactccattaaaaagtatacctgtcagcaacacgccggtggccaattctgaggctagcaccctttcaacaactcctgttgactctaacagtcctgtggtcacttctacagcagtcagttcatctcctacacctgctgaaggtaccagcatagcaatctcaacgcctagtgaaggaagcactgcattaacaagtatacctgtcagcaccacaacagtggccagttctgaaatcaacagcctttcaacaactcctgctgtcaccagcacacctgtgaccacttattctcaagccagttcatctcctacaactgctgacggtaccagcatgcaaacctcaacttatagtgaaggaagcactccactaacaagtttgcctgtcagcaccatgctggtggtcagttctgaggctaacaccctttcaacaacccctattgactccaaaactcaggtgaccgcttctactgaagccagttcatctacaaccgctgaaggtagcagcatgacaatctcaactcctagtgaaggaagtcctctattaacaagtatacctgtcagcaccacgccggtggccagtcctgaggctagcaccctttcaacaactcctgttgactccaacagtcctgtgatcacttctactgaagtcagttcatctcctacacctgctgaaggtaccagcatgccaacctcaacttatactgaaggaagaactcctttaacaagtataactgtcagaacaacaccggtggccagctctgcaatcagcaccctttcaacaactcccgttgacaacagcacacctgtgaccacttctactgaagcccgttcatctcctacaacttctgaaggtaccagcatgccaaactcaactcctagtgaaggaaccactccattaacaagtatacctgtcagcaccacgccggtactcagttctgaggctagcaccctttcagcaactcctattgacaccagcacccctgtgaccacttctactgaagccacttcgtctcctacaactgctgaaggtaccagcataccaacctcgactcttagtgaaggaatgactccattaacaagcacacctgtcagccacacgctggtggccaattctgaggctagcaccctttcaacaactcctgttgactctaacagtcctgtggtcacttctacagcagtcagttcatctcctacacctgctgaaggtaccagcatagcaacctcaacgcctagtgaaggaagcactgcattaacaagtatacctgtcagcaccacaacagtggccagttctgaaaccaacaccctttcaacaactcccgctgtcaccagcacacctgtgaccacttatgctcaagtcagttcatctcctacaactgctgacggtagcagcatgccaacctcaactcctagggaaggaaggcctccattaacaagtatacctgtcagcaccacaacagtggccagttctgaaatcaacaccctttcaacaactcttgctgacaccaggacacctgtgaccacttattctcaagccagttcatctcctacaactgctgatggtaccagcatgccaaccccagcttatagtgaaggaagcactccactaacaagtatgcctctcagcaccacgctggtggtcagttctgaggctagcactctttccacaactcctgttgacaccagcactcctgccaccacttctactgaaggcagttcatctcctacaactgcaggaggtaccagcatacaaacctcaactcctagtgaacggaccactccattagcaggtatgcctgtcagcactacgcttgtggtcagttctgagggtaacaccctttcaacaactcctgttgactccaaaactcaggtgaccaattctactgaagccagttcatctgcaaccgctgaaggtagcagcatgacaatctcagctcctagtgaaggaagtcctctactaacaagtatacctctcagcaccacgccggtggccagtcctgaggctagcaccctttcaacaactcctgttgactccaacagtcctgtgatcacttctactgaagtcagttcatctcctatacctactgaaggtaccagcatgcaaacctcaacttatagtgacagaagaactcctttaacaagtatgcctgtcagcaccacagtggtggccagttctgcaatcagcaccctttcaacaactcctgttgacaccagcacacctgtgaccaattctactgaagcccgttcatctcctacaacttctgaaggtaccagcatgccaacctcaactcctagtgaaggaagcactccattcacaagtatgcctgtcagcaccatgccggtagttacttctgaggctagcaccctttcagcaactcctgttgacaccagcacacctgtgaccacttctactgaagccacttcatctcctacaactgctgaaggtaccagcataccaacttcaactcttagtgaaggaacgactccattaacaagtatacctgtcagccacacgctggtggccaattctgaggttagcaccctttcaacaactcctgttgactccaacactcctttcactacttctactgaagccagttcacctcctcccactgctgaaggtaccagcatgccaacctcaacttctagtgaaggaaacactccattaacacgtatgcctgtcagcaccacaatggtggccagttttgaaacaagcacactttctacaactcctgctgacaccagcacacctgtgactacttattctcaagccggttcatctcctacaactgctgacgatactagcatgccaacctcaacttatagtgaaggaagcactccactaacaagtgtgcctgtcagcaccatgccggtggtcagttctgaggctagcacccattccacaactcctgttgacaccagcacacctgtcaccacttctactgaagccagttcatctcctacaactgctgaaggtaccagcataccaacctcacctcctagtgaaggaaccactccgttagcaagtatgcctgtcagcaccacgccggtggtcagttctgaggctggcaccctttccacaactcctgttgacaccagcacacctatgaccacttctactgaagccagttcatctcctacaactgctgaagatatcgtcgtgccaatctcaactgctagtgaaggaagtactctattaacaagtatacctgtcagcaccacgccagtggccagtcctgaggctagcaccctttcaacaactcctgttgactccaacagtcctgtggtcacttctactgaaatcagttcatctgctacatccgctgaaggtaccagcatgcctacctcaacttatagtgaaggaagcactccattaagaagtatgcctgtcagcaccaagccgttggccagttctgaggctagcactctttcaacaactcctgttgacaccagcatacctgtcaccacttctactgaaaccagttcatctcctacaactgcaaaagataccagcatgccaatctcaactcctagtgaagtaagtacttcattaacaagtatacttgtcagcaccatgccagtggccagttctgaggctagcaccctttcaacaactcctgttgacaccaggacacttgtgaccacttccactggaaccagttcatctcctacaactgctgaaggtagcagcatgccaacctcaactcctggtgaaagaagcactccattaacaaatatacttgtcagcaccacgctgttggccaattctgaggctagcaccctttcaacaactcctgttgacaccagcacacctgtcaccacttctgctgaagccagttcttctcctacaactgctgaaggtaccagcatgcgaatctcaactcctagtgatggaagtactccattaacaagtatacttgtcagcaccctgccagtggccagttctgaggctagcaccgtttcaacaactgctgttgacaccagcatacctgtcaccacttctactgaagccagttcctctcctacaactgctgaagttaccagcatgccaacctcaactcctagtgaaacaagtactccattaactagtatgcctgtcaaccacacgccagtggccagttctgaggctggcaccctttcaacaactcctgttgacaccagcacacctgtgaccacttctactaaagccagttcatctcctacaactgctgaaggtatcgtcgtgccaatctcaactgctagtgaaggaagtactctattaacaagtatacctgtcagcaccacgccggtggccagttctgaggctagcaccctttcaacaactcctgttgataccagcatacctgtcaccacttctactgaaggcagttcttctcctacaactgctgaaggtaccagcatgccaatctcaactcctagtgaagtaagtactccattaacaagtatacttgtcagcaccgtgccagtggccggttctgaggctagcaccctttcaacaactcctgttgacaccaggacacctgtcaccacttctgctgaagctagttcttctcctacaactgctgaaggtaccagcatgccaatctcaactcctggcgaaagaagaactccattaacaagtatgtctgtcagcaccatgccggtggccagttctgaggctagcaccctttcaagaactcctgctgacaccagcacacctgtgaccacttctactgaagccagttcctctcctacaactgctgaaggtaccggcataccaatctcaactcctagtgaaggaagtactccattaacaagtatacctgtcagcaccacgccagtggccattcctgaggctagcaccctttcaacaactcctgttgactccaacagtcctgtggtcacttctactgaagtcagttcatctcctacacctgctgaaggtaccagcatgccaatctcaacttatagtgaaggaagcactccattaacaggtgtgcctgtcagcaccacaccggtgaccagttctgcaatcagcaccctttcaacaactcctgttgacaccagcacacctgtgaccacttctactgaagcccattcatctcctacaacttctgaaggtaccagcatgccaacctcaactcctagtgaaggaagtactccattaacatatatgcctgtcagcaccatgctggtagtcagttctgaggatagcaccctttcagcaactcctgttgacaccagcacacctgtgaccacttctactgaagccacttcatctacaactgctgaaggtaccagcattccaacctcaactcctagtgaaggaatgactccattaactagtgtacctgtcagcaacacgccggtggccagttctgaggctagcatcctttcaacaactcctgttgactccaacactcctttgaccacttctactgaagccagttcatctcctcccactgctgaaggtaccagcatgccaacctcaactcctagtgaaggaagcactccattaacaagtatgcctgtcagcaccacaacggtggccagttctgaaacgagcaccctttcaacaactcctgctgacaccagcacacctgtgaccacttattctcaagccagttcatctcctccaattgctgacggtactagcatgccaacctcaacttatagtgaaggaagcactccactaacaaatatgtctttcagcaccacgccagtggtcagttctgaggctagcaccctttccacaactcctgttgacaccagcacacctgtcaccacttctactgaagccagtttatctcctacaactgctgaaggtaccagcataccaacctcaagtcctagtgaaggaaccactccattagcaagtatgcctgtcagcaccacgccggtggtcagttctgaggttaacaccctttcaacaactcctgtggactccaacactctggtgaccacttctactgaagccagttcatctcctacaatcgctgaaggtaccagcttgccaacctcaactactagtgaaggaagcactccattatcaattatgcctctcagtaccacgccggtggccagttctgaggctagcaccctttcaacaactcctgttgacaccagcacacctgtgaccacttcttctccaaccaattcatctcctacaactgctgaagttaccagcatgccaacatcaactgctggtgaaggaagcactccattaacaaatatgcctgtcagcaccacaccggtggccagttctgaggctagcaccctttcaacaactcctgttgactccaacacttttgttaccagttctagtcaagccagttcatctccagcaactcttcaggtcaccactatgcgtatgtctactccaagtgaaggaagctcttcattaacaactatgctcctcagcagcacatatgtgaccagttctgaggctagcacaccttccactccttctgttgacagaagcacacctgtgaccacttctactcagagcaattctactcctacacctcctgaagttatcaccctgccaatgtcaactcctagtgaagtaagcactccattaaccattatgcctgtcagcaccacatcggtgaccatttctgaggctggcacagcttcaacacttcctgttgacaccagcacacctgtgatcacttctacccaagtcagttcatctcctgtgactcctgaaggtaccaccatgccaatctggacgcctagtgaaggaagcactccattaacaactatgcctgtcagcaccacacgtgtgaccagctctgagggtagcaccctttcaacaccttctgttgtcaccagcacacctgtgaccacttctactgaagccatttcatcttctgcaactcttgacagcaccaccatgtctgtgtcaatgcccatggaaataagcacccttgggaccactattcttgtcagtaccacacctgttacgaggtttcctgagagtagcaccccttccataccatctgtttacaccagcatgtctatgaccactgcctctgaaggcagttcatctcctacaactcttgaaggcaccaccaccatgcctatgtcaactacgagtgaaagaagcactttattgacaactgtcctcatcagccctatatctgtgatgagtccttctgaggccagcacactttcaacacctcctggtgataccagcacacctttgctcacctctaccaaagccggttcattctccatacctgctgaagtcactaccatacgtatttcaattaccagtgaaagaagcactccattaacaactctccttgtcagcaccacacttccaactagctttcctggggccagcatagcttcgacacctcctcttgacacaagcacaacttttaccccttctactgacactgcctcaactcccacaattcctgtagccaccaccatatctgtatcagtgatcacagaaggaagcacacctgggacaaccatttttattcccagcactcctgtcaccagttctactgctgatgtctttcctgcaacaactggtgctgtatctacccctgtgataacttccactgaactaaacacaccatcaacctccagtagtagtaccaccacatctttttcaactactaaggaatttacaacacccgcaatgactactgcagctcccctcacatatgtgaccatgtctactgcccccagcacacccagaacaaccagcagaggctgcactacttctgcatcaacgctttctgcaaccagtacacctcacacctctacttctgtcaccacccgtcctgtgaccccttcatcagaatccagcaggccgtcaacaattacttctcacaccatcccacctacatttcctcctgctcactccagtacacctccaacaacctctgcctcctccacgactgtgaaccctgaggctgtcaccaccatgaccaccaggacaaaacccagcacacggaccacttccttccccacggtgaccaccaccgctgtccccacgaatactacaattaagagcaaccccacctcaactcctactgtgccaagaaccacaacatgctttggagatgggtgccagaatacggcctctcgctgcaagaatggaggcacctgggatgggctcaagtgccagtgtcccaacctctattatggggagttgtgtgaggaggtggtcagcagcattgacatagggccaccggagactatctctgcccaaatggaactgactgtgacagtgaccagtgtgaagttcaccgaagagctaaaaaaccactcttcccaggaattccaggagttcaaacagacattcacggaacagatgaatattgtgtattccgggatccctgagtatgtcggggtgaacatcacaaagctacgtcttggcagtgtggtggtggagcatgacgtcctcctaagaaccaagtacacaccagaatacaagacagtattggacaatgccaccgaagtagtgaaagagaaaatcacaaaagtgaccacacagcaaataatgattaatgatatttgctcagacatgatgtgtttcaacaccactggcacccaagtgcaaaacattacggtgacccagtacgaccctgaagaggactgccggaagatggccaaggaatatggagactacttcgtagtggagtaccgggaccagaagccatactgcatcagcccctgtgagcctggcttcagtgtctccaagaactgtaacctcggcaagtgccagatgtctctaagtggacctcagtgcctctgcgtgaccacggaaactcactggtacagtggggagacctgtaaccagggcacccagaagagtctggtgtacggcctcgtgggggcaggggtcgtgctgatgctgatcatcctggtagctctcctgatgctcgttttccgctccaagagagaggtgaaacggcaaaagtacagattgtctcagttatacaagtggcaagaagaggacagtggaccagctcctgggaccttccaaaacattggctttgacatctgccaagatgatgattccatccacctggagtccatctatagtaatttccagccctccttgagacacatagaccctgaaacaaagatccgaattcagaggcctcaggtaatgacgacatcattttaaggcatggagctgagaagtctgggagtgaggagatcccagtccggctaagcttggtggagcattttcccattgagagccttccatgggaactcaatgttcccattgtaagtacaggaaacaagccctgtacttaccaaggagaaagaggagagacagcagtgctgggagattctcaaatagaaacccgtggacgctccaatgggcttgtcatgatatcaggctaggctttcctgctcatttttcaaagacgctccagatttgagggtactctgactgcaacatctttcaccccattgatcgccaggattgatttggttgatctggctgagcaggcgggtgtccccgtcctccctcactgccccatatgtgtccctcctaaagctgcatgctcagttgaagaggacgagaggacgaccttctctgatagaggaggaccacgcttcagtcaaaggcatacaagtatctatctggacttccctgctagcacttccaaacaagctcagagatgttcctcccctcatctgcccgggttcagtaccatggacagcgccctcgacccgctgtttacaaccatgaccccttggacactggactgcatgcactttacatatcacaaaatgctctcataagaattattgcataccatcttcatgaaaaacacctgtatttaaatatagagcatttaccttttggta

SEQ ID NO: 18674 - DNA, 2446 bp, Homo sapiens
aggcacctctggggtggcacctggcacaacagttgcccctggaagtttcagcacagcagctacaacttctcctggagcaagtggagtgactggcactggacccactgcagagaccacaactttcctaggaggaagtagcaccactggagcagaaataaaatcaggagccaccactggagcaccaggaagtaagacaggcacagctaaagtgctctctggtacgacagttgcctctgggagctccaactcagaggctacaactttctctggaatcactgaagcagtaacagtcccaagtaaaaatggatctatgaccactgcactggggagccaactctccagcagtcaaacagtgattccaggttccagtggcaccatctctcacacaactgttgcacctggaagttctgttacaggaaccaccactggtgcatcagatgatcaagtcactggaagtaaaacaggcactactggtgtggccttgagcacaactgttgcacctggaagttccagtacagaagccacaacttccacaggagtccatagaaccactgtagtgggacagaagacaggagctaccactagagggtcagcaaagcaaggaactagaagcacaatagaagctacgacgtcctttagaggcactgggaccacaggaagtggaatgaatacaggtactactggagtggtctctggcaacaccatctcacctagcagtttcaacacagaagctaccagtggcacatctgagaggccaaaccctggaagtgaaataggcaccactggcatagtctctggcacaacagttgcacctggaagttccaacacagaagccacaacttctttgggcaatggtggaaccactgaggctggaagtaaaatagttaccactgggataactactggcacgaccattgtacctgggagtttcaacacaaaggctaccacttctacagacgttggagttgccactggagttggaatggcaactgggatcaccaacataatttcagggagaagccaacctactggaagtaaaacaggctacactgtaacaggctctggaacaacagccttacctggaggtttcagaacagattctccatcttttccacttttcttgatttgctcttacagaggccacaacttttaaaggtgatgttggaaccactgaagcagaaatttcatcaggcaataccccaggatcaacgggagtcaccagcagccaagaaggaaccactgtggtatcaagtggaatcactggaatcccagaaacttccatctcaggtccttccaaggaagcatctgacaaaaccactgctcctggacctcctaccacagtcactgcttccacaggagtcaaagaaacttctgaaactggagtgcaaacaggctccaccttggttacagctggagtgccaacaagaccacaagtatcccagccagaaaccactgtcgtggcaaccagagaagtagaaaccgaaaataaaacagaatgtctagcctcacttccaccagctccaggtttgtcacggtccattgggagaagagaaatctcctggagacatatggactgccaattgccacagaggtacctgtactgatgcaaagactatagactgtaaacctgaggagtgcccttctccacccacatgcaaaaccggcgagaagcttgtgaagttccaatctaatgacacctgctgtgaaatcggatactgtgaaccaagaacatgtttatttaacaatactgactatgagattggtgcttcattcgatgaccccagcaacccctgtgtctcctactcctgcaaagacacgggctttgctgcagtagtccaggactgcccaaagcaaacctggtgtgcagaagcaagtcatcttaactaatgaacgccgagattcagttctcatattaaacaaaccctggccgggcgcggtggctcaggcctgtaatcccagcactgtgggaggccgaggcgggcggatcacctgaggtcagaggaagacagaatctatgattcaaaaaaatgttgctatacatgtaagaataattgcagatcttcccttgtaaatgtgactgttatctacagtggttgcaagaaaagagttcagatggcaaaatgcacaggggaatgtgaaaagactgccaagtacaattatgatatcttactcttggaacattcatgcctttgctgccgagaagaaaactatgaactcagagacattgtacttgactgtcctgatggcagtacaatcccttaccaatacaagcatatcacgacctgctcttgtttagacatatgccaactatatacgaccttcatgtacagttaatgctgacatcaccttcccagttttaacaggcctggtatttattttataagtgaggaaaaataatcatttaaaaagtgagaataaactaaacaatgtgagaataactcaaaac

SEQ ID NO: 18675 - DNA, 1243 bp, Homo sapiens
cccaccggcacacagaccccaaccccgacacccatctccaccaccactacggtgaccccaaccccaacacccaccggcacacagaccccaaccacgacacccatcaccaccaccaccacggtgaccccaaccccgacacccaccggcacacagaccccaaccacggtactcatcaccaccaccactacgatgaccccaaccccaacacccaccagcacaaagagtacaaccgtgacacccatcaccaccacaactacggtgaccgcaaccccaacacccaccggcacacagaccccaaccatgatacccatcagcaccaccactacggtgaccccaaccccaacacccaccactggaagcacggggccccccacccacacaagcacagcacccattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcact

SEQ ID NO: 18676 - DNA, 5340 bp, Homo sapiens
atggggctgccactagcccgcctggcggctgtgtgcctggccctgtctttggcagggggctcggagctccagacagagggcagaacccgaaaccacggccacaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggaaggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctggtgcacatgcacacaaacgcacacagcataccacgtgcacacacacggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccaccaccttcaccactaccaccaccaccaccaccccgacctccagcacagttttatcaacaactccgaagctgtgctgcctctggtctgactggatcaatgaggaccaccccagcagtggcagcgacgacggtgaccgagaaacatttgatggggtctgcggggcccctgaggacatcgagtgcaggtcggtcaaggatccccacctcagcttggagcagctaggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccagcacgaccacccttccaccaaccaccacccccagccctccaaccaccaccacaaccacccctccaccaaccaccacccccagccctccaataaccaccacgaccacccctccaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaacgactacgcccatcactccaccagccagcactaccacccttccaccaaccaccactcccagccctccaacaaccaccacaaccacccctccaccaaccaccactcccatcaccaccaccaccacggtgaccccaaccccaacacccaccggcacacagaccccaacaacgacacccatcaccaccaccaccacggtgaccccaaccccaacacccaccggcacacagaccccaacatcgacacccatcaccaccaccactacgaccccaaccccaacagccatcaccaccaccactacggtgaccccaaccccaacacccaccggcacacagaccccaaccacgacacccatcaccaccaccactacggtgacaccaaccccaacacccaccggcacacagtccccaaccccaacagccatcaccaccaccactacggtgaccccaaccccaacacccaccggcacacagaccccaacatcgacacccatcaccaccaccactacggtgaccccaaccccaacacccaccggcacacagaccccaaccccgacacccatctccaccaccactacggtgaccccaaccccaacacccaccggcacacagaccccaaccacgacacccatcaccaccaccaccacggtgaccccaaccccgacacccaccggcacacagaccccaaccacgaccccaacacccaccagcacaaagagtacaaccgtgacacccatcaccaccacaactacggtgaccgcaaccccaacacccaccggcacacagaccccaaccatgatacccatcagcaccaccactacggtgacccca

SEQ ID NO: 18677 - DNA, 1612 bp, Homo sapiens
gacatcgagtgcaggtcggtcaaggatccccacctcagcttggagcagctaggccagaaggtgcagtgtgatgtctctgttgggttcatttgcaagaatgaagaccagtttggaaatggaccatttggactgtgttacgactacaagatacgtgtcaattgttgctgcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgtccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgctgtaagtgcc

SEQ ID NO: 18678 - DNA, 8637 bp, Homo sapiens
caacccacaccgcccctgccagccaccatggggctgccactagcccgcctggcggctgtgtgcctggccctgtctttggcagggggctcggagctccagacagagggcagaacccgaaaccacggccacaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggaaggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccaccaccttcaccactaccaccaccaccaccaccccgacctccagcacagttttatcaacaactccgaagctgtgctgcctctggtctgactggatcaatgaggaccaccccagcagtggcagcgacgacggtgaccgagaaacatttgatggggtctgcggggcccctgaggacatcgagtgcaggtcggtcaaggatccccacctcagcttggagcagctaggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccagcacgaccacccttccaccaaccaccacccccagccctccaaccaccaccacaaccacccctccaccaaccaccacccccagccctccaataaccaccacgaccacccctccaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaacgactacgcccatcactccaccagccagcactaccacccttccaccaaccaccactcccagccctccaacaaccaccacaaccacccctccaccaaccaccactcccatcaccaccaccaccacggtgaccccaaccccaacacccaccggcacacagaccccaacaacgacacccatcaccaccaccaccacggtgaccccaaccccaacacccaccggcacacagaccccaacatcgacacccatcaccaccaccactacggtgaccccaaccccaacacccaccggcacacagaccccaaccacgacacccatcaccaccaccactacggtgaccccaaccccaacacccactggcacacagaccccaaccccaacagccatcaccaccaccactacggtgaccccaaccccaacacccaccggcacacagaccccaaccacgacacccatcaccaccaccactacggtgacaccaaccccaacacccaccggcacacagtccccaaccccaacagccatcaccaccaccactacggtgaccccaaccccaacacccaccggcacacagaccccaacatcgacacccatcaccaccaccactacggtgaccccaaccccaacacccaccggcacacagaccccaaccccgacacccatctccaccaccactacggtgaccccaaccccaacacccaccggcacacagaccccaaccacgacacccatcaccaccaccaccacggtgaccccaaccccgacacccaccggcacacagaccccaaccacggtactcatcaccaccaccactacgatgaccccaaccccaacacccaccagcacaaagagtacaaccgtgacacccatcaccaccacaactacggtgaccgcaaccccaacacccaccggcacacagaccccaaccatgatacccatcagcaccaccactacggtgaccccaaccccaacacccaccactggaagcacggggccccccacccacacaagcacagcacccattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgtccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgctgt

SEQ ID NO: 18679 - DNA, 3338 bp, Homo sapiens
atctactccacagtcagcacatccacaactgccatcacctcacattttactacctcagagactgcggtgactcccacacctgtaaccccatcttctctgagtacagacatcccgaccacaagcctacgaactctcaccccttcgtctgtgggcaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaaccccaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccctccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggacagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctccagaacgccagccaggatgcgaacagctgccaggactcccagaccctgtgttttaagcctgactccatcaaggtgaacaacaacagcaagacagagctgaccccggaagccatctgccgccgcgccgctcccacgggctatgaagagttctacttccctctggtggaggccacccggctccgctgtgtcaccaaatgcacgtcgggcgtggacaacgccatcgactgtcaccagggccagtgcgttctagagacgagcggtcccgcgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttccatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgtcgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtca

SEQ ID NO: 18680 - DNA, 1073 bp, Homo sapiens
tgtgacaatggtggcacctgggaacagggacagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctccagaacgccagccaggatgcgaacagctgccaggactcccagaccctgtgttttaagcctgactccatcaaggtgaacaacaacagcaagacagagctgaccccggaagccatctgccgccgcgccgctcccacgggctatgaagagttctacttccctctggtggaggccacccggctccgctgtgtcaccaaatgcacgtcgggcgtggacaacgccatcgactgtcaccagggccagtgcgttctagagacgagcggtcccgcgtgtcggtcctgggaccaggacaggaaatggttcgagacctgggatgaggaagtcgtgggcactttttcaaactggggtttcgaggacgacggaacagacaaggatacaaatttccatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatccc

SEQ ID NO: 18681 - DNA, 3982 bp, Homo sapiens
ggagcttccccagggagccagggggacttttgccgcagccatgaagggggcacgctggaggagggtcccctgggtgtccctgagctgcctgtgtctctgcctccttccgcatgtggtcccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 18682 - DNA, 3829 bp, Homo sapiens
ggagcttccccagggagccagggggacttttgccgcagccatgaagggggcacgctggaggagggtcccctgggtgtccctgagctgcctgtgtctctgcctccttccgcatgtggtcccaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 18683 - DNA, 5857 bp, Homo sapiens
ccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 18684 - DNA, 17110 bp, Homo sapiens
tacagccccaaggtcgctccctctggggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 18685 - DNA, 16273 bp, Homo sapiens
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 18686 - DNA, 1860 bp, Homo sapiens
atgagtgttggccggaggaagctggccctgctctgggccctggctctcgctctggcctgcacccggcacacaggccatgcccaggatggctcctccgaatccagctacaagcaccaccctgccctctctcctatcgcccgggggcccagcggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcaagagcagcagctacaccaaggtggaggccaggctgggccttgtcctcatgtggaaccacgatgacagcctgctgctggctggacaccaaatacgccaacaagctgtgggctctgtggggacttcaacgggatgcccgtggtcagcgagctcctctcccacaacaccaagctgacacccatggaattcgggaacctgcaagatggacgaccccacggagcagtgtcaggaccctgtccctgaacccccgaggaactgctccactggctttgggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgtgcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggaggttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggtgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaat

SEQ ID NO: 18687 - DNA, 1917 bp, Homo sapiens
ctcagaggctgctgagggacagggcactcttccccgccgtccacacaatgagtgttggccggaggaagctggccctgctctgggccctggctctcgctctggcctgcacccggcacacaggccatgcccaggatggctcctccgaatccagctacaagcaccaccctgccctctctcctatcgcccgggggcccagcggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggaggccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgaggaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgtgcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggaggttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggtgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatg

SEQ ID NO: 18688 - DNA, 17747 bp, Homo sapiens
acccggcccggctccctccctgcccgtccccgtccccccacccgtgccagcccccaggatgggtgccccgagcgcgtgccggacgctggtgttggctctggcggccatgctcgtggtgccgcaggcagagacccagggccctgtggagccgagctgggagaatgcagggcacaccatggatggcggtgccccgacgtcctcgcccacccggcgcgtgagctttgttccacccgtcactgtcttccccagcctgagccccctgaacccggcgcacaatgggcgggtgtgcagcacctggggtgacttccactacaagaccttcgacggcgacgtcttccgcttccctggcctttgcaactacgtgttctctgagcactgccgcgccgcctacgaggacttcaacgtccagctacgccgaggcctagtgggctccaggcctgtggtcacccgtgttgtcatcaaggcccaggggctggtgctggaggcgtccaacggctccgtcctcatcaatgggcagcgggaggagctgccttacagccgcactggcctcctggtggagcagagcggggactacatcaaggtcagcatccggctggtgctgacattcctgtggaacggagaggacagtgccctgctggagctggatcccaaatacgccaaccagacctgtggcctgtgtggggacttcaacggcctcccggccttcaacgagttctatgcccacaacgccaggctgaccccgctccagtttgggaacctgcagaagttggatgggcccacggagcagtgcccggacccgctgcccttgccggccggcaactgcacggacgaggagggcatctgccaccgcaccctgctggggccggcctttgcggagtgccacgcactggtggacagcactgcgtacctggccgcctgcgcccaggacctgtgccgctgccccacctgcccgtgtgccacctttgtggaatactcacgccagtgcgcccacgcggggggccagccgcggaactggaggtgccctgagctctgcccccggacctgccccctcaacatgcagcaccaggagtgtggctcaccctgcacggacacctgctccaacccccagcgcgcgcagctctgcgaggaccactgtgtggacggctgcttctgccccccaggcagcacggtgctggatgacatcacgcactctggctgcctgcccctcgggcagtgcccctgcacccacggcggccgcacctacagcccgggcacctccttcaacaccacctgcagctcctgcacctgctccggggggctatggcagtgccaggacctgccgtgccctggcacctgctctgtgcagggcggggcccacatctccacctatgatgagaaactctacgacctgcatggtgactgcagctacgttctgtccaagaaatgtgccgacagcagcttcaccgtgctggctgagctgcggaagtgcggcctgacggacaacgagaactgcctgaaagcggtgacgctcagcctggacggcggggacacggccatccgggtccaagcggacggcggcgtgttcctcaactccatctacacgcagctgcccctgtcggcagccaacatcaccctgttcacaccctcgagcttcttcatcgtggtgcagacaggcctggggctgcagctgctggtgcagctggtgccactcatgcaggtgtttgtcaggctggaccccgcccaccagggccagatgtgcggcctgtgtgggaacttcaaccagaaccaggctgacgacttcacggccctcagcggggtggtggaggccacgggcgcagccttcgccaacacctggaaggcccaggctgcctgtgccaatgccaggaacagctttgaggacccctgctccctcagtgtggagaatgagaactacgcccggcactggtgctcgcgcctgaccgatcccaacagtgccttctcgcgctgccactccatcatcaaccccaagcccttccactcgaactgcatgtttgacacctgcaactgtgagcggagcgaggactgcctgtgcgccgcgctgtcctcctatgtgcacgcctgtgccgccaagggcgtacagctcagcgactggagggacggcgtctgcaccaagtacatgcagaactgccccaagtcccagcgctacgcctacgtggtggatgcctgccagcccacttgccgcggcctgagtgaggccgacgtcacctgcagcgtttccttcgtgcctgtggacggctgcacctgccccgcgggcaccttcctcaatgacgcgggcgcctgtgtgcccgcccaggagtgcccctgctacgctcacggcaccgtgctggctcctggagaggtggtgcacgacgagggcgccgtgtgttcatgtacgggtgggaagctaagctgcctgggagcctctctgcagaaaagcacagggtgtgcagcccccatggtgtacctggactgcagcaacagctcggcgggcacccctggggccgagtgcctccggagctgccacacgctggacgtgggctgtttcagcacacactgcgtgtccggctgtgtctgtcccccggggctggtgtcggatgggagtgggggctgcattgccgaggaggactgcccctgtgtgcacaacgaggccacctacaagcctggagagaccatcagggtcgactgcaacacctgcacctgcaggaaccggaggtgggagtgcagccaccggctctgcctgggcacctgcgtggcctacggggatggccacttcatcacctttgatggcgatcgctacagctttgaaggcagctgcgagtacatcttggcccaggactactgtggggacaacaccacccacgggaccttccgcatcgtcaccgagaacatcccctgtgggaccaccggcaccacctgctccaaggccatcaagctcttcgtggagagctacgagctgatcctccaagaggggacctttaaggcggtggcgagagggccgggtggggacccaccctacaagatacgctacatggggatcttcctggtcatcgagacccacgggatggccgtgtcctgggaccggaagaccagcgtgttcatccgactgcaccaggactacaagggcagggtctgcggcctgtgcgggaacttcgacgacaatgccatcaatgactttgccacgcgtagccggtccgtggtgggggacgcactggagtttgggaacagctggaagctctccccctcctgcccggacgccctggcacccaaggacccctgcacggccaaccccttccgcaagtcctgggcccagaagcagtgcagcatcctccacggccccaccttcgccgcctgccgctcccaggttgactccaccaagtactacgaggcctgcgtgaacgacgcgtgtgcctgcgactcgggtggcgactgcgagtgtttctgcacggctgtggctgcctacgcccaggcctgccacgacgcgggcctgtgtgtgtcctggcggactccggacacctgccccttgttctgtgacttctacaacccacatgggggctgtgagtggcactaccagccctgcggggcaccctgcctaaaaacctgccggaaccccagtgggcactgcctggtggacctgcctggcctggaaggctgctacccgaagtgcccacccagccagcccttcttcaatgaggaccagatgaagtgcgtggcccagtgtggctgctacgacaaggacggaaactactatgacgtcggtgcaagggtccccacagcggagaactgccagagctgtaactgcacacccagtggcatccagtgcgctcacagccttgaggcctgcacctgcacctatgaggacaggacctacagctaccaggacgtcatctacaacaccaccgatgggcttggcgcctgcttgatcgccatctgcggaagcaacggcaccatcatcaggaaggctgtggcatgtcctggaactccagccacaacgccattcaccttcaccaccgcctgggtcccccactccacgacaagcccggccctcccggtctccaccgtgtgtgtccgcgaggtctgccgctggtccagctggtacaatgggcaccgcccagagcccggcctgggaggcggagactttgagacgtttgaaaacctgaggcagagagggtaccaggtatgccctgtgctggctgacatcgagtgccgggcggcgcagcttcccgacatgccgctggaggagctgggccagcaggtggactgtgaccgcatgcgggggctgatgtgcgccaacagccaacagagtcccccgctctgtcacgactacgagctgcgggttctctgctgcgaatacgtgccctgtggcccctccccggccccaggcaccagccctcagccctccctcagtgccagcacggagcctgctgtgcctaccccaacccagaccacagcaaccgaaaagaccaccctatgggtgaccccgagcatccggtcgacggcggccctcacctcgcagactgggtccagctcaggccccgtgacggtcaccccctcggccccaggtaccaccacctgccagccccggtgtcagtggacagagtggtttgatgaggactaccccaagtctgaacaacttggaggggacgttgagtcctacgataagatcagggccgctggagggcacttatgccagcagcctaaggacatagagtgccaggccgagagcttccccaactggaccctggcacaggtggggcagaaggtgcactgtgacgtccacttcggcctggtgtgcaggaactgggagcaggagggcgtcttcaagatgtgctacaactacaggatccgggtcctctgctgcagtgacgaccactgcaggggacgtgccacaaccccgccaccgaccacagagctggagacggccaccaccaccaccacccaggccctgttctcaacgccgcagcctacgagtagcccggggctgaccagggctcccccggccagcaccacagcagtccccaccctctcagaaggactgacatcccccagatacacaagcacccttggtacagccaccacgggaggccccacgacgcctgcaggctccacagaacccactgtcccaggggtggccacatccacccttccaacacgctcagcccttccagggacgacggggagcttgggcacatggcgcccctcacagccacccacgctggccccaacaacaatggcaacctccagagctcgcccgacaggcacagccagcaccgcttccaaagagccgctgaccacgagcctggcgccaacactcacgagcgagctgtccacctctcaggccgagaccagcacgcccaggacagagacgacaatgagccccttgactaacaccaccaccagccagggcacgacccgctgtcaaccgaagtgtgagtggacagagtggtttgacgtggacttcccaacctcaggggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactgccccagtaccccagccaccagctccacggccacgccctcctcaactccggggacgacctggatcctcacaaagccgaccacaacagccactacgactgcgtccactggatccacggccaccccgacctccaccctgagaacagctccccctcccaaagtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccgccacggccaccacaactggggccaccggctctgtggccaccccctcctccaccccaggaacagctcacactaccaaagtgccaactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacggccaccggctccaccaccaacccctcctcaactcctgggacaactcccatccccccagtgctgaccaccaccgccaccacacctgcagccaccagcaacacagtgactccctcctctgccctagggaccacccacacacccccagtgccgaacaccatggccaccacacacgggcgatccctgccccccagcagtccccacacggtgcgcacagcctggacttcggccacctcgggcatcttgggcaccacccacatcacagagccttccacggtgacttcccacaccctagcagcaaccaccggtaccacccagcactcgactccagccctttccagccctcaccctagcagcagaaccaccgagtcacccccttctccagggacgaccaccccgggccacaccacggccacctccaggaccacagccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgagtccactggatccacggccaccccgtcctccaccccagcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgaccccctcctccatcccggggaccacccacacccccacagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttctccagggacgaccaccccgggccacaccagggccacctccaggaccacggccacggccacacccagcaagacccgcacctcgaccctgctgcccagcagccccacatcggccccaataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctccactccagggacgacctggatcctcacagagcagaccacagcagccactacgaccgcaaccactggatccacggccatcccgtcctccaccccgggaacagctccccctcccaaagtgctgaccagcacggccaccacacccacagccaccagttccaaagccacttcctcctccagtccaaggactgcaaccacccttccagtgctgacaagcacagccaccaaatccacagctaccagctttacacccatcccctccttcacccttgggaccaccgggaccctcccagaacagaccaccacacccatggccaccatgtccacaatccacccctcctccactccggagaccacccacacctccacagtgctgaccacgaaggccaccacgacaagggccaccagttccatgtccaccccctcctccactccggggacgacctggatcctcacagagctgaccacagcagccactacaactgcagccactggccccacggccaccccgtcctccaccccagggaccacctggatcctcacagagcccagcactacagccaccgtgacggtgcccaccggatccacggccaccgcctcctccacccgggcaactgctggcaccctcaaagtgctgaccagcacggccaccacacccacagtcatcagctccagagccactccctcctccagtccagggactgcaaccgcccttccagcactgagaagcacagccaccacacccacagctaccagcgttacagccatcccctcttcctccctgggcaccgcctggacccgcctatcacagaccaccacacccacggccaccatgtccacagccacaccctcctctactccagagactgtccacacctccacagtgcttaccaccacgaccaccacaaccagggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacagccaccggctccaccaccaacccctcctcaactccagggacaactcccatccccccagtgctgaccaccaccgccaccacacctgcagccaccagcagcacagtgactccctcctctgccctagggaccacccacacacccccagtgccgaacaccacggccaccacacacgggcggtccctgccccccagcagtccccacacggtgcgcacagcctggacttcggccacctcgggcatcttgggcaccacccacatcacagagccttccacggtgacttcccacaccccagcagcaaccaccagtaccacccagcactcgactccagccctgtccagccctcaccctagcagcaggaccaccgagtcacccccttctccagggacgaccaccccgggccacaccaggggcacctccaggaccacagccacagccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggcagtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctcaactccggggacgacctggatcctcacaaagctgaccacaacagccactacgactgagtccactggatccacggccaccccgtcctccaccccaggggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgcccacacctccacagtgcttaccaccacggccaccacaaccagggccaccggctctgtggccaccccctcttccaccccaggaacagctcacactaccaaagtgccgactaccacaaccacgggcttcacagtcaccccctcctccagcccagggacggcacgcacgcctccagtgtggatcagcacaaccaccacacccacaaccagtggctccacggtgaccccctcctccgtcccggggaccacccacacccccacagtgctgaccaccaccaccacaactgtggccactggttctatggcaacaccctcctctagcacacagaccagtggtactcccccatcactgatcaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttccccagggacgaccaccccgggccacaccacggccacctccaggaccacggccacggccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgggggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgcatccactggatccacggccaccccgtcctccaccccgggaacagctccccctcccaaagtgctgaccagcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggaccctcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacccatcaccccagtgctgaccagcacggccaccacacccgcagccaccagctccaaagccacttcctcctccagtccaaggactgcaaccacccttccagtgctgacaagcacagccacaaaatccacagctaccagctttacacccatcccctcctccaccctgtggaccacgtggaccgtcccagcacagaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttctctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgctgggccccgactggcacaccccccactgccagccccgcagccccggtgtctagcacacccacccccaccccatgcccaccacagccgctctgtgatctgatgctgagccaggtctttgctgagtgccacaaccttgtgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgtggatgagtgtggctgcacgcccttctgtgtccctgcgcccatggctcccccacacacccgtggcttcccggcccaggaggccactgctgtctgagaacgttctgcctccatccccatgctctgtccacctggagccaggatgtgcattgtctgatcatgaaaaccttgggcctcctctgcggagccccccggcctgtgtgtggcaccccgcgctccgtgctcctgctgcccaccccgtgggtgaaaccggccccagaagggtgaggggccagcaggacccctttcgggagggcgccactcaggagtcctaccctgggagagcctgtggcccaccttggccttgcccctccctgatgtcactgggacgccctggaacaaactaagcatgtgcgggcctatgtgtccctgccacggccggagcgcccgcgcagcacggattccagctggccacgtccggccgctggggcagacaggctggtccaggcaaggccagctgctgccaggaagctgcgacaggcaaggcggccgcctgtccatgcctgctgcagggtaactcagggctgaggtcgcaacggccaggtcagagaggggtcagcatcccaaagccccctctgctcaacccagcccagttttgcaaataaaccctgagcattgagtacgtt

SEQ ID NO: 18689 - DNA, 16584 bp, Homo sapiens
gcccccaggatgggtgccccgagcgcgtgccggacgctggtgttggctctggcggccatgctcgtggtgccgcaggcaggtaagagccccccactccgccccctctcgagaaactcaggggctggcttggatgggggtgccccgacgtcctcgcccacccggcgcgtgagctttgttccacccgtcactgtcttccccagcctgagccgtaagcagatgctgcccctgccagccgggaagggggtgtttgccagtcccaaaggtgggggcccagatctaggggtgcagctgccaccagccctgaacccggcgcacaatgggcgggtgtgcagcacctggggtgacttccactacaagaccttcgacggcgacgtcttccgcttccctggcctttgcaactacgtgttctctgagcactgccgcgccgcctacgaggacttcaacgtccagctacgccgaggcctagtgggctccaggcctgtggtcacccgtgttgtcatcaaggcccaggggctggtgctggaggcgtccaacggctccgtcctcatcaatgggcagcgggaggagctgccttacagccgcactggcctcctggtggagcagagcggggactacatcaaggtcagcatccggctggtgctgacattcctgtggaacggagaggacagtgccctgctggagctggatcccaaatacgccaaccagacctgtggcctgtgtggggacttcaacggcctcccggccttcaacgagttctatgcccacaacgccaggctgaccccgctccagtttgggaacctgcagaagttggatgggcccacggagcagtgcccggacccgctgcccttgccggccggcaactgcacggacgaggagggcatctgccaccgcaccctgctggggccggcctttgcggagtgccacgcactggtggacagcactgcgtacctggccgcctgcgcccaggacctgtgccgctgccccacctgcccgtgtgccacctttgtggaatactcacgccagtgcgcccacgcggggggccagccgcggaactggaggtgccctgagctctgcccccggacctgccccctcaacatgcagcaccaggagtgtggctcaccctgcacggacacctgctccaacccccagcgcgcgcagctctgcgaggaccactgtgtggacggctgcttctgccccccaggcaggtcttgcacggtgctggatgacatcacgcactctggctgcctgcccctcgggcagtgcccctgcacccacggcggccgcacctacagcccgggcacctccttcaacaccacctgcagctcctgcacctgctccggggggctatggcagtgccaggacctgccgtgccctggcacctgctctgtgcagggcggggcccacatctccacctatgatgagaaactctacgacctgcatggtgactgcagctacgttctgtccaagaaatgtgccgacagcagcttcaccgtgctggctgagctgcggaagtgcggcctgacggacaacgagaactgcctgaaagcggtgacgctcagcctggacggcggggacacggccatccgggtccaagcggacggcggcgtgttcctcaactccatctacacgcagctgcccctgtcggcagccaacatcaccctgttcacaccctcgagcttcttcatcgtggtgcagacaggcctggggctgcagctgctggtgcagctggtgccactcatgcaggtgtttgtcaggctggaccccgcccaccagggccagatgtgcggcctgtgtgggaacttcaaccagaaccaggctgacgacttcacggccctcagcggggtggtggaggccacgggcgcagccttcgccaacacctggaaggcccaggctgcctgtgccaatgccaggaacagctttgaggacccctgctccctcagtgtggagaatgagaactacgcccggcactggtgctcgcgcctgaccgatcccaacagtgccttctcgcgctgccactccatcatcaaccccaagcccttccactcgaactgcatgtttgacacctgcaactgtgagcggagcgaggactgcctgtgcgccgcgctgtcctcctatgtgcacgcctgtgccgccaagggcgtacagctcagcgactggagggacggcgtctgcaccaagtacatgcagaactgccccaagtcccagcgctacgcctacgtggtggatgcctgccagcccacttgccgcggcctgagtgaggccgacgtcacctgcagcgtttccttcgtgcctgtggacggctgcacctgccccgcgggcaccttcctcaatgacgcgggcgcctgtgtgcccgcccaggagtgcccctgctacgctcacggcaccgtgctggctcctggagaggtggtgcacgacgagggcgccgtgtgttcatgtacgggtgggaagctaagctgcctgggagcctctctgcagaaaagcacagggtgtgcagcccccatggtgtacctggactgcagcaacagctcggcgggcacccctggggccgagtgcctccggagctgccacacgctggacgtgggctgtttcagcacacactgcgtgtccggctgtgtctgtcccccggggctggtgtcggatgggagtgggggctgcattgccgaggaggactgcccctgtgtgcacaacgaggccacctacaagcctggagagaccatcagggtcgactgcaacacctgcacctgcaggaaccggaggtgggagtgcagccaccggctctgcctgggcacctgcgtggcctacggggatggccacttcatcacctttgatggcgatcgctacagctttgaaggcagctgcgagtacatcttggcccaggactactgtggggacaacaccacccacgggaccttccgcatcgtcaccgagaacatcccctgtgggaccaccggcaccacctgctccaaggccatcaagctcttcgtggaggtgagaacggccccagctgtgagcacccccgaccctgcagccaacgagccggcccccagggaagcttcggtcggcttccggcagcgtctgcctcccctgcagagctacgagctgatcctccaagaggggacctttaaggcggtggcgagagggccgggtggggacccaccctacaagatacgctacatggggatcttcctggtcatcgagacccacgggatggccgtgtcctgggaccggaagaccagcgtgttcatccgactgcaccaggactacaagggcagggtctgcggcctgtgcgggaacttcgacgacaatgccatcaatgactttgccacgcgtagccggtccgtggtgggggacgcactggagtttgggaacagctggaagctctccccctcctgcccggacgccctggcacccaaggacccctgcacggccaaccccttccgcaagtcctgggcccagaagcagtgcagcatcctccacggccccaccttcgccgcctgccgctcccaggttgactccaccaagtactacgaggcctgcgtgaacgacgcgtgtgcctgcgactcgggtggcgactgcgagtgtttctgcacggctgtggctgcctacgcccaggcctgccacgacgcgggcctgtgtgtgtcctggcggactccggacacctgccccttgttctgtgacttctacaacccacatgggggctgtgagtggcactaccagccctgcggggcaccctgcctaaaaacctgccggaaccccagtgggcactgcctggtggacctgcctggcctggaaggctgctacccgaagtgcccacccagccagcccttcttcaatgaggaccagatgaagtgcgtggcccagtgtggctgctacgacaaggacggaaactactatgacgtcggtgcaagggtccccacagcggagaactgccagagctgtaactgcacacccagtggcatccagtgcgctcacagccttgaggcctgcacctgcacctatgaggacaggacctacagctaccaggacgtcatctacaacaccaccgatgggcttggcgcctgcttgatcgccatctgcggaagcaacggcaccatcatcaggaaggctgtggcatgtcctggaactccagccacaacgccattcaccttcaccaccgcctgggtcccccactccacgacaagcccggccctcccggtctccaccgtgtgtgtccgcgaggtctgccgctggtccagctggtacaatgggcaccgcccagagcccggcctgggaggcggagactttgagacgtttgaaaacctgaggcagagagggtaccaggtatgccctgtgctggctgacatcgagtgccgggcggcgcagcttcccgacatgccgctggaggagctgggccagcaggtggactgtgaccgcatgcgggggctgatgtgcgccaacagccaacagagtcccccgctctgtcacgactacgagctgcgggttctctgctgcgaatacgtgccctgtggcccctccccggccccaggcaccagccctcagccctccctcagtgccagcacggagcctgctgtgcctaccccaacccagaccacagcaaccgaaaagaccaccctatgggtgaccccgagcatccggtcgacggcggccctcacctcgcagactgggtccagctcaggccccgtgacggtcaccccctcggccccaggtaccaccacctgccagccccggtgtcagtggacagagtggtttgatgaggactaccccaagtctgaacaacttggaggggacgttgagtcctacgataagatcagggccgctggagggcacttatgccagcagcctaaggacatagagtgccaggccgagagcttccccaactggaccctggcacaggtggggcagaaggtgcactgtgacgtccacttcggcctggtgtgcaggaactgggagcaggagggcgtcttcaagatgtgctacaactacaggatccgggtcctctgctgcagtgacgaccactgcaggggacgtgccacaaccccgccaccgaccacagagctggagacggccaccaccaccaccacccaggccctgttctcaacgccgcagcctacgagtagcccggggctgaccagggctcccccggccagcaccacagcagtccccaccctctcagaaggactgacatcccccagatacacaagcacccttggtacagccaccacgggaggccccacgacgcctgcaggctccacagaacccactgtcccaggggtggccacatccacccttccaacacgctcagcccttccagggacgacggggagcttgggcacatggcgcccctcacagccacccacgctggccccaacaacaatggcaacctccagagctcgcccgacaggcacagccagcaccgcttccaaagagccgctgaccacgagcctggcgccaacactcacgagcgagctgtccacctctcaggccgagaccagcacgcccaggacagagacgacaatgagccccttgactaacaccaccaccagccagggcacgacccgctgtcaaccgaagtgtgagtggacagagtggtttgacgtggacttcccaacctcaggggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactgccccagtaccccagccaccagctccacggccacgccctcctcaactccggggacgacctggatcctcacaaagccgaccacaacagccactacgactgcgtccactggatccacggccaccccgacctccaccctgagaacagctccccctcccaaagtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccgccacggccaccacaactggggccaccggctctgtggccaccccctcctccaccccaggaacagctcacactaccaaagtgccaactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtgggaccacccacacacccccagtgccgaacaccatggccaccacacacgggcgatccctgccccccagcagtccccacacggtgcgcacagcctggacttcggccacctcgggcatcttgggcaccacccacatcacagagccttccacggtgacttcccacaccctagcagcaaccaccggtaccacccagcactcgactccagccctttccagccctcaccctagcagcagaaccaccgagtcacccccttctccagggacgaccaccccgggccacaccacggccacctccaggaccacagccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgaccccctcctccatcccggggaccacccacacccccacagtgctgaccaccaccaccacaactgtggccactggttctatggcaacaccctcctctagcacacagaccagtgggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttctccagggacgaccaccccgggccacaccagggccacctccaggaccacggccacggccacacccagcaagacccgcacctcgaccctgctgcccagcagccccacatcggccccaataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctccactccagggacgacctggatcctcacagagcagaccacagcagccactacgaccgcaaccactggatccacggccatcccgtcctccaccccgggaacagctccccctcccaaagtgctgaccagcacggccaccacacccacagccaccagttccaaagccacttcctcctccagtccaaggactgcaaccacccttccagtgctgacaagcacagccaccaaatccacagctaccagctttacacccatcccctccttcacccttgggaccaccgggaccctcccagaacagaccaccacacccatggccaccatgtccacaatccacccctcctccactccggagaccacccacacctccacagtgctgaccacgaaggccaccacgacaagggccaccagttccatgtccaccccctcctccactccggggacgacctggatcctcacagagctgaccacagcagccactacaactgcagccactggccccacggccaccccgtcctccaccccagggaccacctggatcctcacagagcccagcactacagccaccgtgacggtgcccaccggatccacggccaccgcctcctccacccgggcaactgctggcaccctcaaagtgctgaccagcacggccaccacacccacagtcatcagctccagagccactccctcctccagtccagggactgcaaccgcccttccagcactgagaagcacagccaccacacccacagctaccagcgttacagccatcccctcttcctccctgggcaccgcctggacccgcctatcacagaccaccacacccacggccaccatgtccacagccacaccctcctctactccagagactgtccacacctccacagtgcttaccaccacgaccaccacaaccagggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtgggaccacccacacacccccagtgccgaacaccacggccaccacacacgggcggtccctgccccccagcagtccccacacggtgcgcacagcctggacttcggccacctcgggcatcttgggcaccacccacatcacagagccttccacggtgacttcccacaccccagcagcaaccaccagtaccacccagcactcgactccagccctgtccagccctcaccctagcagcaggaccaccgagtcacccccttctccagggacgaccaccccgggccacaccaggggcacctccaggaccacagccacagccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggcagtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctcaactccggggacgacctggatcctcacaaagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgcccacacctccacagtgcttaccaccacggccaccacaaccagggccaccggctctgtggccaccccctcttccaccccaggaacagctcacactaccaaagtgccgactaccacaaccacgggcttcacagtcaccccctcctccagcccagggacggcacgcacgcctccagtgtggatcagcacaaccaccacacccacaaccagtggctccacggtgaccccctcctccgtcccggggaccacccacacccccacagtgctgaccaccaccaccacaactgtggccactggttctatggcaacaccctcctctagcacacagaccagtgggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttccccagggacgaccaccccgggccacaccacggccacctccaggaccacggccacggccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgggggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgcatccactggatccacggccaccccgtcctccaccccgggaacagctccccctcccaaagtgctgaccagcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggaccctcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccaaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttctctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgtgagtgcgtcggtggccgcgggattaccccgggggcaggcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgctgggccccgactggcacaccccccactgccagccccgcagccccggtgtctagcacacccacccccaccccatgcccaccacagccgctctgtgatctgatgctgagccaggtctttgctgagtgccacaaccttgtgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgctgtccaggtcctctgtgggctgcttgcctggggcctgcaggctggaggacacatccggggggcagtccaggacccccagcagccactgaaggaccaggaagcctctgggaaggccaggcaggggggtggctacaggcagaccgtggcctggggagacaaaagcaatgctcgtgcctggctgcagaagcctgtggtgtgggtgcagagcggggccttccccacaccggggcctgcctctgccctgtgcccttgg

SEQ ID NO: 18690 - DNA, 17924 bp, Homo sapiens
acccggcccggctccctccctgcccgtccccgtccccccacccgtgccagcccccaggatgggtgccccgagcgcgtgccggacgctggtgttggctctggcggccatgctcgtggtgccgcaggcagagacccagggccctgtggagccgagctgggagaatgcagggcacaccatggatggcggtgccccgacgtcctcgcccacccggcgcgtgagctttgttccacccgtcactgtcttccccagcctgagccccctgaacccggcgcacaatgggcgggtgtgcagcacctggggtgacttccactacaagaccttcgacggcgacgtcttccgcttccctggcctttgcaactacgtgttctctgagcactgccgcgccgcctacgaggacttcaacgtccagctacgccgaggcctagtgggctccaggcctgtggtcacccgtgttgtcatcaaggcccaggggctggtgctggaggcgtccaacggctccgtcctcatcaatgggcagcgggaggagctgccttacagccgcactggcctcctggtggagcagagcggggactacatcaaggtcagcatccggctggtgctgacattcctgtggaacggagaggacagtgccctgctggagctggatcccaaatacgccaaccagacctgtggcctgtgtggggacttcaacggcctcccggccttcaacgagttctatgcccacaacgccaggctgaccccgctccagtttgggaacctgcagaagttggatgggcccacggagcagtgcccggacccgctgcccttgccggccggcaactgcacggacgaggagggcatctgccaccgcaccctgctggggccggcctttgcggagtgccacgcactggtggacagcactgcgtacctggccgcctgcgcccaggacctgtgccgctgccccacctgcccgtgtgccacctttgtggaatactcacgccagtgcgcccacgcggggggccagccgcggaactggaggtgccctgagctctgcccccggacctgccccctcaacatgcagcaccaggagtgtggctcaccctgcacggacacctgctccaacccccagcgcgcgcagctctgcgaggaccactgtgtggacggctgcttctgccccccaggcaggtcttgcacggtgctggatgacatcacgcactctggctgcctgcccctcgggcagtgcccctgcacccacggcggccgcacctacagcccgggcacctccttcaacaccacctgcagctcctgcacctgctccggggggctatggcagtgccaggacctgccgtgccctggcacctgctctgtgcagggcggggcccacatctccacctatgatgagaaactctacgacctgcatggtgactgcagctacgttctgtccaagaaatgtgccgacagcagcttcaccgtgctggctgagctgcggaagtgcggcctgacggacaacgagaactgcctgaaagcggtgacgctcagcctggacggcggggacacggccatccgggtccaagcggacggcggcgtgttcctcaactccatctacacgcagctgcccctgtcggcagccaacatcaccctgttcacaccctcgagcttcttcatcgtggtgcagacaggcctggggctgcagctgctggtgcagctggtgccactcatgcaggtgtttgtcaggctggaccccgcccaccagggccagatgtgcggcctgtgtgggaacttcaaccagaaccaggctgacgacttcacggccctcagcggggtggtggaggccacgggcgcagccttcgccaacacctggaaggcccaggctgcctgtgccaatgccaggaacagctttgaggacccctgctccctcagtgtggagaatgagaactacgcccggcactggtgctcgcgcctgaccgatcccaacagtgccttctcgcgctgccactccatcatcaaccccaagcccttccactcgaactgcatgtttgacacctgcaactgtgagcggagcgaggactgcctgtgcgccgcgctgtcctcctatgtgcacgcctgtgccgccaagggcgtacagctcagcgactggagggacggcgtctgcaccaagtacatgcagaactgccccaagtcccagcgctacgcctacgtggtggatgcctgccagcccacttgccgcggcctgagtgaggccgacgtcacctgcagcgtttccttcgtgcctgtggacggctgcacctgccccgcgggcaccttcctcaatgacgcgggcgcctgtgtgcccgcccaggagtgcccctgctacgctcacggcaccgtgctggctcctggagaggtggtgcacgacgagggcgccgtgtgttcatgtacgggtgggaagctaagctgcctgggagcctctctgcagaaaagcacagggtgtgcagcccccatggtgtacctggactgcagcaacagctcggcgggcacccctggggccgagtgcctccggagctgccacacgctggacgtgggctgtttcagcacacactgcgtgtccggctgtgtctgtcccccggggctggtgtcggatgggagtgggggctgcattgccgaggaggactgcccctgtgtgcacaacgaggccacctacaagcctggagagaccatcagggtcgactgcaacacctgcacctgcaggaaccggaggtgggagtgcagccaccggctctgcctgggcacctgcgtggcctacggggatggccacttcatcacctttgatggcgatcgctacagctttgaaggcagctgcgagtacatcttggcccaggactactgtggggacaacaccacccacgggaccttccgcatcgtcaccgagaacatcccctgtgggaccaccggcaccacctgctccaaggccatcaagctcttcgtggagagctacgagctgatcctccaagaggggacctttaaggcggtggcgagagggccgggtggggacccaccctacaagatacgctacatggggatcttcctggtcatcgagacccacgggatggccgtgtcctgggaccggaagaccagcgtgttcatccgactgcaccaggactacaagggcagggtctgcggcctgtgcgggaacttcgacgacaatgccatcaatgactttgccacgcgtagccggtccgtggtgggggacgcactggagtttgggaacagctggaagctctccccctcctgcccggacgccctggcacccaaggacccctgcacggccaaccccttccgcaagtcctgggcccagaagcagtgcagcatcctccacggccccaccttcgccgcctgccgctcccaggttgactccaccaagtactacgaggcctgcgtgaacgacgcgtgtgcctgcgactcgggtggcgactgcgagtgtttctgcacggctgtggctgcctacgcccaggcctgccacgacgcgggcctgtgtgtgtcctggcggactccggacacctgccccttgttctgtgacttctacaacccacatgggggctgtgagtggcactaccagccctgcggggcaccctgcctaaaaacctgccggaaccccagtgggcactgcctggtggacctgcctggcctggaaggctgctacccgaagtgcccacccagccagcccttcttcaatgaggaccagatgaagtgcgtggcccagtgtggctgctacgacaaggacggaaactactatgacgtcggtgcaagggtccccacagcggagaactgccagagctgtaactgcacacccagtggcatccagtgcgctcacagccttgaggcctgcacctgcacctatgaggacaggacctacagctaccaggacgtcatctacaacaccaccgatgggcttggcgcctgcttgatcgccatctgcggaagcaacggcaccatcatcaggaaggctgtggcatgtcctggaactccagccacaacgccattcaccttcaccaccgcctgggtcccccactccacgacaagcccggccctcccggtctccaccgtgtgtgtccgcgaggtctgccgctggtccagctggtacaatgggcaccgcccagagcccggcctgggaggcggagactttgagacgtttgaaaacctgaggcagagagggtaccaggtatgccctgtgctggctgacatcgagtgccgggcggcgcagcttcccgacatgccgctggaggagctgggccagcaggtggactgtgaccgcatgcgggggctgatgtgcgccaacagccaacagagtcccccgctctgtcacgactacgagctgcgggttctctgctgcgaatacgtgccctgtggcccctccccggccccaggcaccagccctcagccctccctcagtgccagcacggagcctgctgtgcctaccccaacccagaccacagcaaccgaaaagaccaccctatgggtgaccccgagcatccggtcgacggcggccctcacctcgcagactgggtccagctcaggccccgtgacggtcaccccctcggccccaggtaccaccacctgccagccccggtgtcagtggacagagtggtttgatgaggactaccccaagtctgaacaacttggaggggacgttgagtcctacgataagatcagggccgctggagggcacttatgccagcagcctaaggacatagagtgccaggccgagagcttccccaactggaccctggcacaggtggggcagaaggtgcactgtgacgtccacttcggcctggtgtgcaggaactgggagcaggagggcgtcttcaagatgtgctacaactacaggatccgggtcctctgctgcagtgacgaccactgcaggggacgtgccacaaccccgccaccgaccacagagctggagacggccaccaccaccaccacccaggccctgttctcaacgccgcagcctacgagtagcccggggctgaccagggctcccccggccagcaccacagcagtccccaccctctcagaaggactgacatcccccagatacacaagcacccttggtacagccaccacgggaggccccacgacgcctgcaggctccacagaacccactgtcccaggggtggccacatccacccttccaacacgctcagcccttccagggacgacggggagcttgggcacatggcgcccctcacagccacccacgctggccccaacaacaatggcaacctccagagctcgcccgacaggcacagccagcaccgcttccaaagagccgctgaccacgagcctggcgccaacactcacgagcgagctgtccacctctcaggccgagaccagcacgcccaggacagagacgacaatgagccccttgactaacaccaccaccagccagggcacgacccgctgtcaaccgaagtgtgagtggacagagtggtttgacgtggacttcccaacctcaggggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactgccccagtaccccagccaccagctccacggccacgccctcctcaactccggggacgacctggatcctcacaaagccgaccacaacagccactacgactgcgtccactggatccacggccaccccgacctccaccctgagaacagctccccctcccaaagtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccgccacggccaccacaactggggccaccggctctgtggccaccccctcctccaccccaggaacagctcacactaccaaagtgccaactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacggccaccggctccaccaccaacccctcctcaactcctgggacaactcccatccccccagtgctgaccaccaccgccaccacacctgcagccaccagcaacacagtgactccctcctctgccctagggaccacccacacacccccagtgccgaacaccatggccaccacacacgggcgatccctgccccccagcagtccccacacggtgcgcacagcctggacttcggccacctcgggcatcttgggcaccacccacatcacagagccttccacggtgacttcccacaccctagcagcaaccaccggtaccacccagcactcgactccagccctttccagccctcaccctagcagcagaaccaccgagtcacccccttctccagggacgaccaccccgggccacaccacggccacctccaggaccacagccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgaccccctcctccatcccggggaccacccacacccccacagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttctccagggacgaccaccccgggccacaccagggccacctccaggaccacggccacggccacacccagcaagacccgcacctcgaccctgctgcccagcagccccacatcggccccaataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctccactccagggacgacctggatcctcacagagcagaccacagcagccactacgaccgcaaccactggatccacggccatcccgtcctccaccccgggaacagctccccctcccaaagtgctgaccagcacggccaccacacccacagccaccagttccaaagccacttcctcctccagtccaaggactgcaaccacccttccagtgctgacaagcacagccaccaaatccacagctaccagctttacacccatcccctccttcacccttgggaccaccgggaccctcccagaacagaccaccacacccatggccaccatgtccacaatccacccctcctccactccggagaccacccacacctccacagtgctgaccacgaaggccaccacgacaagggccaccagttccatgtccaccccctcctccactccggggacgacctggatcctcacagagctgaccacagcagccactacaactgcagccactggccccacggccaccccgtcctccaccccagggaccacctggatcctcacagagcccagcactacagccaccgtgacggtgcccaccggatccacggccaccgcctcctccacccgggcaactgctggcaccctcaaagtgctgaccagcacggccaccacacccacagtcatcagctccagagccactccctcctccagtccagggactgcaaccgcccttccagcactgagaagcacagccaccacacccacagctaccagcgttacagccatcccctcttcctccctgggcaccgcctggacccgcctatcacagaccaccacacccacggccaccatgtccacagccacaccctcctctactccagagactgtccacacctccacagtgcttaccaccacgaccaccacaaccagggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacagccaccggctccaccaccaacccctcctcaactccagggacaactcccatccccccagtgctgaccaccaccgccaccacacctgcagccaccagcagcacagtgactccctcctctgccctagggaccacccacacacccccagtgccgaacaccacggccaccacacacgggcggtccctgccccccagcagtccccacacggtgcgcacagcctggacttcggccacctcgggcatcttgggcaccacccacatcacagagccttccacggtgacttcccacaccccagcagcaaccaccagtaccacccagcactcgactccagccctgtccagccctcaccctagcagcaggaccaccgagtcacccccttctccagggacgaccaccccgggccacaccaggggcacctccaggaccacagccacagccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggcagtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctcaactccggggacgacctggatcctcacaaagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgcccacacctccacagtgcttaccaccacggccaccacaaccagggccaccggctctgtggccaccccctcttccaccccaggaacagctcacactaccaaagtgccgactaccacaaccacgggcttcacagtcaccccctcctccagcccagggacggcacgcacgcctccagtgtggatcagcacaaccaccacacccacaaccagtggctccacggtgaccccctcctccgtcccggggaccacccacacccccacagtgctgaccaccaccaccacaactgtggccactggttctatggcaacaccctcctctagcacacagaccagtggtactcccccatcactgatcaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttccccagggacgaccaccccgggccacaccacggccacctccaggaccacggccacggccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgggggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgcatccactggatccacggccaccccgtcctccaccccgggaacagctccccctcccaaagtgctgaccagcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggaccctcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacccatcaccccagtgctgaccagcacggccaccacacccgcagccaccagctccaaagccacttcctcctccagtccaaggactgcaaccacccttccagtgctgacaagcacagccacaaaatccacagctaccagctttacacccatcccctcctccaccctgtggaccacgtggaccgtcccagcacagaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttctctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgctgggccccgactggcacaccccccactgccagccccgcagccccggtgtctagcacacccacccccaccccatgcccaccacagccgctctgtgatctgatgctgagccaggtctttgctgagtgccacaaccttgtgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgtggatgagtgtggctgcacgcccttctgtgtccctgcgcccatggctcccccacacacccgtggcttcccggcccaggaggccactgctgtctgagaacgttctgcctccatccccatgctctgtccacctggagccaggatgtgcattgtctgatcatgaaaaccttgggcctcctctgcggagccccccggcctgtgtgtggcaccccgcgctccgtgctcctgctgcccaccccgtgggtgaaaccggccccagaagggtgaggggccagcaggacccctttcgggagggcgccactcaggagtcctaccctgggagagcctgtggcccaccttggccttgcccctccctgatgtcactgggacgccctggaacaaactaagcatgtgcgggcctatgtgtccctgccacggccggagcgcccgcgcagcacggattccagctggccacgtccggccgctggggcagacaggctggtccaggcaaggccagctgctgccaggaagctgcgacaggcaaggcggccgcctgtccatgcctgctgcagggtaactcagggctgaggtcgcaacggccaggtcagagaggggtcagcatcccaaagccccctctgctcaacccagcccagttttgcaaataaaccctgagcattgagtacgtt

SEQ ID NO: 18691 - DNA, 17911 bp, Homo sapiens
acccggcccggctccctccctgcccgtccccgtccccccacccgtgccagcccccaggatgggtgccccgagcgcgtgccggacgctggtgttggctctggcggccatgctcgtggtgccgcaggcagagacccagggccctgtggagccgagctgggagaatgcagggcacaccatggatggcggtgccccgacgtcctcgcccacccggcgcgtgagctttgttccacccgtcactgtcttccccagcctgagccccctgaacccggcgcacaatgggcgggtgtgcagcacctggggtgacttccactacaagaccttcgacggcgacgtcttccgcttccctggcctttgcaactacgtgttctctgagcactgccgcgccgcctacgaggacttcaacgtccagctacgccgaggcctagtgggctccaggcctgtggtcacccgtgttgtcatcaaggcccaggggctggtgctggaggcgtccaacggctccgtcctcatcaatgggcagcgggaggagctgccttacagccgcactggcctcctggtggagcagagcggggactacatcaaggtcagcatccggctggtgctgacattcctgtggaacggagaggacagtgccctgctggagctggatcccaaatacgccaaccagacctgtggcctgtgtggggacttcaacggcctcccggccttcaacgagttctatgcccacaacgccaggctgaccccgctccagtttgggaacctgcagaagttggatgggcccacggagcagtgcccggacccgctgcccttgccggccggcaactgcacggacgaggagggcatctgccaccgcaccctgctggggccggcctttgcggagtgccacgcactggtggacagcactgcgtacctggccgcctgcgcccaggacctgtgccgctgccccacctgcccgtgtgccacctttgtggaatactcacgccagtgcgcccacgcggggggccagccgcggaactggaggtgccctgagctctgcccccggacctgccccctcaacatgcagcaccaggagtgtggctcaccctgcacggacacctgctccaacccccagcgcgcgcagctctgcgaggaccactgtgtggacggctgcttctgccccccaggcacggtgctggatgacatcacgcactctggctgcctgcccctcgggcagtgcccctgcacccacggcggccgcacctacagcccgggcacctccttcaacaccacctgcagctcctgcacctgctccggggggctatggcagtgccaggacctgccgtgccctggcacctgctctgtgcagggcggggcccacatctccacctatgatgagaaactctacgacctgcatggtgactgcagctacgttctgtccaagaaatgtgccgacagcagcttcaccgtgctggctgagctgcggaagtgcggcctgacggacaacgagaactgcctgaaagcggtgacgctcagcctggacggcggggacacggccatccgggtccaagcggacggcggcgtgttcctcaactccatctacacgcagctgcccctgtcggcagccaacatcaccctgttcacaccctcgagcttcttcatcgtggtgcagacaggcctggggctgcagctgctggtgcagctggtgccactcatgcaggtgtttgtcaggctggaccccgcccaccagggccagatgtgcggcctgtgtgggaacttcaaccagaaccaggctgacgacttcacggccctcagcggggtggtggaggccacgggcgcagccttcgccaacacctggaaggcccaggctgcctgtgccaatgccaggaacagctttgaggacccctgctccctcagtgtggagaatgagaactacgcccggcactggtgctcgcgcctgaccgatcccaacagtgccttctcgcgctgccactccatcatcaaccccaagcccttccactcgaactgcatgtttgacacctgcaactgtgagcggagcgaggactgcctgtgcgccgcgctgtcctcctatgtgcacgcctgtgccgccaagggcgtacagctcagcgactggagggacggcgtctgcaccaagtacatgcagaactgccccaagtcccagcgctacgcctacgtggtggatgcctgccagcccacttgccgcggcctgagtgaggccgacgtcacctgcagcgtttccttcgtgcctgtggacggctgcacctgccccgcgggcaccttcctcaatgacgcgggcgcctgtgtgcccgcccaggagtgcccctgctacgctcacggcaccgtgctggctcctggagaggtggtgcacgacgagggcgccgtgtgttcatgtacgggtgggaagctaagctgcctgggagcctctctgcagaaaagcacagggtgtgcagcccccatggtgtacctggactgcagcaacagctcggcgggcacccctggggccgagtgcctccggagctgccacacgctggacgtgggctgtttcagcacacactgcgtgtccggctgtgtctgtcccccggggctggtgtcggatgggagtgggggctgcattgccgaggaggactgcccctgtgtgcacaacgaggccacctacaagcctggagagaccatcagggtcgactgcaacacctgcacctgcaggaaccggaggtgggagtgcagccaccggctctgcctgggcacctgcgtggcctacggggatggccacttcatcacctttgatggcgatcgctacagctttgaaggcagctgcgagtacatcttggcccaggactactgtggggacaacaccacccacgggaccttccgcatcgtcaccgagaacatcccctgtgggaccaccggcaccacctgctccaaggccatcaagctcttcgtggagagctacgagctgatcctccaagaggggacctttaaggcggtggcgagagggccgggtggggacccaccctacaagatacgctacatggggatcttcctggtcatcgagacccacgggatggccgtgtcctgggaccggaagaccagcgtgttcatccgactgcaccaggactacaagggcagggtctgcggcctgtgcgggaacttcgacgacaatgccatcaatgactttgccacgcgtagccggtccgtggtgggggacgcactggagtttgggaacagctggaagctctccccctcctgcccggacgccctggcacccaaggacccctgcacggccaaccccttccgcaagtcctgggcccagaagcagtgcagcatcctccacggccccaccttcgccgcctgccgctcccaggttgactccaccaagtactacgaggcctgcgtgaacgacgcgtgtgcctgcgactcgggtggcgactgcgagtgtttctgcacggctgtggctgcctacgcccaggcctgccacgacgcgggcctgtgtgtgtcctggcggactccggacacctgccccttgttctgtgacttctacaacccacatgggggctgtgagtggcactaccagccctgcggggcaccctgcctaaaaacctgccggaaccccagtgggcactgcctggtggacctgcctggcctggaaggctgctacccgaagtgcccacccagccagcccttcttcaatgaggaccagatgaagtgcgtggcccagtgtggctgctacgacaaggacggaaactactatgacgtcggtgcaagggtccccacagcggagaactgccagagctgtaactgcacacccagtggcatccagtgcgctcacagccttgaggcctgcacctgcacctatgaggacaggacctacagctaccaggacgtcatctacaacaccaccgatgggcttggcgcctgcttgatcgccatctgcggaagcaacggcaccatcatcaggaaggctgtggcatgtcctggaactccagccacaacgccattcaccttcaccaccgcctgggtcccccactccacgacaagcccggccctcccggtctccaccgtgtgtgtccgcgaggtctgccgctggtccagctggtacaatgggcaccgcccagagcccggcctgggaggcggagactttgagacgtttgaaaacctgaggcagagagggtaccaggtatgccctgtgctggctgacatcgagtgccgggcggcgcagcttcccgacatgccgctggaggagctgggccagcaggtggactgtgaccgcatgcgggggctgatgtgcgccaacagccaacagagtcccccgctctgtcacgactacgagctgcgggttctctgctgcgaatacgtgccctgtggcccctccccggccccaggcaccagccctcagccctccctcagtgccagcacggagcctgctgtgcctaccccaacccagaccacagcaaccgaaaagaccaccctatgggtgaccccgagcatccggtcgacggcggccctcacctcgcagactgggtccagctcaggccccgtgacggtcaccccctcggccccaggtaccaccacctgccagccccggtgtcagtggacagagtggtttgatgaggactaccccaagtctgaacaacttggaggggacgttgagtcctacgataagatcagggccgctggagggcacttatgccagcagcctaaggacatagagtgccaggccgagagcttccccaactggaccctggcacaggtggggcagaaggtgcactgtgacgtccacttcggcctggtgtgcaggaactgggagcaggagggcgtcttcaagatgtgctacaactacaggatccgggtcctctgctgcagtgacgaccactgcaggggacgtgccacaaccccgccaccgaccacagagctggagacggccaccaccaccaccacccaggccctgttctcaacgccgcagcctacgagtagcccggggctgaccagggctcccccggccagcaccacagcagtccccaccctctcagaaggactgacatcccccagatacacaagcacccttggtacagccaccacgggaggccccacgacgcctgcaggctccacagaacccactgtcccaggggtggccacatccacccttccaacacgctcagcccttccagggacgacggggagcttgggcacatggcgcccctcacagccacccacgctggccccaacaacaatggcaacctccagagctcgcccgacaggcacagccagcaccgcttccaaagagccgctgaccacgagcctggcgccaacactcacgagcgagctgtccacctctcaggccgagaccagcacgcccaggacagagacgacaatgagccccttgactaacaccaccaccagccagggcacgacccgctgtcaaccgaagtgtgagtggacagagtggtttgacgtggacttcccaacctcaggggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactgccccagtaccccagccaccagctccacggccacgccctcctcaactccggggacgacctggatcctcacaaagccgaccacaacagccactacgactgcgtccactggatccacggccaccccgacctccaccctgagaacagctccccctcccaaagtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccgccacggccaccacaactggggccaccggctctgtggccaccccctcctccaccccaggaacagctcacactaccaaagtgccaactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacggccaccggctccaccaccaacccctcctcaactcctgggacaactcccatccccccagtgctgaccaccaccgccaccacacctgcagccaccagcaacacagtgactccctcctctgccctagggaccacccacacacccccagtgccgaacaccatggccaccacacacgggcgatccctgccccccagcagtccccacacggtgcgcacagcctggacttcggccacctcgggcatcttgggcaccacccacatcacagagccttccacggtgacttcccacaccctagcagcaaccaccggtaccacccagcactcgactccagccctttccagccctcaccctagcagcagaaccaccgagtcacccccttctccagggacgaccaccccgggccacaccacggccacctccaggaccacagccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgaccccctcctccatcccggggaccacccacacccccacagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttctccagggacgaccaccccgggccacaccagggccacctccaggaccacggccacggccacacccagcaagacccgcacctcgaccctgctgcccagcagccccacatcggccccaataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctccactccagggacgacctggatcctcacagagcagaccacagcagccactacgaccgcaaccactggatccacggccatcccgtcctccaccccgggaacagctccccctcccaaagtgctgaccagcacggccaccacacccacagccaccagttccaaagccacttcctcctccagtccaaggactgcaaccacccttccagtgctgacaagcacagccaccaaatccacagctaccagctttacacccatcccctccttcacccttgggaccaccgggaccctcccagaacagaccaccacacccatggccaccatgtccacaatccacccctcctccactccggagaccacccacacctccacagtgctgaccacgaaggccaccacgacaagggccaccagttccatgtccaccccctcctccactccggggacgacctggatcctcacagagctgaccacagcagccactacaactgcagccactggccccacggccaccccgtcctccaccccagggaccacctggatcctcacagagcccagcactacagccaccgtgacggtgcccaccggatccacggccaccgcctcctccacccgggcaactgctggcaccctcaaagtgctgaccagcacggccaccacacccacagtcatcagctccagagccactccctcctccagtccagggactgcaaccgcccttccagcactgagaagcacagccaccacacccacagctaccagcgttacagccatcccctcttcctccctgggcaccgcctggacccgcctatcacagaccaccacacccacggccaccatgtccacagccacaccctcctctactccagagactgtccacacctccacagtgcttaccaccacgaccaccacaaccagggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacagccaccggctccaccaccaacccctcctcaactccagggacaactcccatccccccagtgctgaccaccaccgccaccacacctgcagccaccagcagcacagtgactccctcctctgccctagggaccacccacacacccccagtgccgaacaccacggccaccacacacgggcggtccctgccccccagcagtccccacacggtgcgcacagcctggacttcggccacctcgggcatcttgggcaccacccacatcacagagccttccacggtgacttcccacaccccagcagcaaccaccagtaccacccagcactcgactccagccctgtccagccctcaccctagcagcaggaccaccgagtcacccccttctccagggacgaccaccccgggccacaccaggggcacctccaggaccacagccacagccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggcagtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctcaactccggggacgacctggatcctcacaaagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgcccacacctccacagtgcttaccaccacggccaccacaaccagggccaccggctctgtggccaccccctcttccaccccaggaacagctcacactaccaaagtgccgactaccacaaccacgggcttcacagtcaccccctcctccagcccagggacggcacgcacgcctccagtgtggatcagcacaaccaccacacccacaaccagtggctccacggtgaccccctcctccgtcccggggaccacccacacccccacagtgctgaccaccaccaccacaactgtggccactggttctatggcaacaccctcctctagcacacagaccagtggtactcccccatcactgatcaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttccccagggacgaccaccccgggccacaccacggccacctccaggaccacggccacggccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgggggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgcatccactggatccacggccaccccgtcctccaccccgggaacagctccccctcccaaagtgctgaccagcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggaccctcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacccatcaccccagtgctgaccagcacggccaccacacccgcagccaccagctccaaagccacttcctcctccagtccaaggactgcaaccacccttccagtgctgacaagcacagccacaaaatccacagctaccagctttacacccatcccctcctccaccctgtggaccacgtggaccgtcccagcacagaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttctctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgctgggccccgactggcacaccccccactgccagccccgcagccccggtgtctagcacacccacccccaccccatgcccaccacagccgctctgtgatctgatgctgagccaggtctttgctgagtgccacaaccttgtgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgtggatgagtgtggctgcacgcccttctgtgtccctgcgcccatggctcccccacacacccgtggcttcccggcccaggaggccactgctgtctgagaacgttctgcctccatccccatgctctgtccacctggagccaggatgtgcattgtctgatcatgaaaaccttgggcctcctctgcggagccccccggcctgtgtgtggcaccccgcgctccgtgctcctgctgcccaccccgtgggtgaaaccggccccagaagggtgaggggccagcaggacccctttcgggagggcgccactcaggagtcctaccctgggagagcctgtggcccaccttggccttgcccctccctgatgtcactgggacgccctggaacaaactaagcatgtgcgggcctatgtgtccctgccacggccggagcgcccgcgcagcacggattccagctggccacgtccggccgctggggcagacaggctggtccaggcaaggccagctgctgccaggaagctgcgacaggcaaggcggccgcctgtccatgcctgctgcagggtaactcagggctgaggtcgcaacggccaggtcagagaggggtcagcatcccaaagccccctctgctcaacccagcccagttttgcaaataaaccctgagcattgagta

SEQ ID NO: 18692 - DNA, 1608 bp, Homo sapiens
gtgttctgctgcaactacggccactgccccccccggccaccagctctacggccatgccctcctccactccggggacgacctggatccacagagctgaccacaacagccactacgactgcatccactggatccacggccaccccgtcctccaccccgggaacagctccccctcccaaagtgctgaccagcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggaccctcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacccacagctaccagctttacagccatcccctcctcctccctaccacctggacccgcctatcacagaccaccacacccacggccaccatgtccacagccacaccctcctccactccagagactgtccacacctccacagtgcttaccgccacggccaccacaaccgggccggctctgtggccaccccctcctccaccccaggaacagctcacactaccaaagtgccgactaccacaaccacggcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtactggttctatggcaacaccctcctctagcacacagaccagtggtactcccccatcactgaccaccacggccactacgatcacggccaccggctccaccaccaacccctcctcaactccagggacaacacccatcaccccagtgctgaccagcacggccaccacacccgcagccaccagctccaaagccacttcctcctccagtccaaggactgcaaccacccttccagtgctgacaagcacagccacaaaatccacagctaccagctttacacccatcccctccccctgtggaccacgtggaccgtcc

SEQ ID NO: 18693 - DNA, 558 bp, Homo sapiens
tcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctgggcaccacctggacccgcctatcacagaccaccacacccacggccaccatgtccacagccacaccctcctccactccagagactgtccacacctccacagtgcttaccaccacggccaccacggggccaccggctctgtggccaccccctcctccaccccaggaacagctcacactaccaaagtgctgactaccacaaccacttcacagccaccccctcctccagcccagggacggcacgcacgcttccagtgtggatcagcacaaccaccacacccacaaccagaggttcc

SEQ ID NO: 18694 - DNA, 957 bp, Homo sapiens
acgaaggccaccacgacaagggccaccagttccatgtccaccccctcctccactccggggacgacctggatcctcacagagctgaccacagcagccactacaactgcagccactccccacggccaccccgtcctccaccccagggaccacctggatcctcacagagcccagcactacaccgtgacggtgcccaccggatccacggccaccgcctcctccacccgggcaactgctggcaccctcaaagtgctgaccagccaccacacccacagtcatcagctccagagccactccctcctccagtccagggactgcaaccgcccttccagcactgagaagcacagccaccacacccacagctaccagcgttacagccatcccctcttcctccctaccgcctggacccgcctatcacagaccaccacacccacggccaccatgtccacagccacaccctcctctactccagagactgtccacacctccacagtgcttaccaccacgaccaccacaaccagggccaccctgtggccaccccctcctccaccccaggaacagctcacactaccaaagtgccgactaccacaaccacggcacagccaccccctcctccagcccagggacggcactcacgcctccagtgtggatcagcacaaccaccacacccacaaccagaggctccacggtgaccccctcctccatcccaccacccacaccgccacagtgctgaccaccaccaccacaactccactggttctatggcaacaccctcctctagcacacagaccagtggtacccccatcactgaccaccacggccactacgatcacagccaccggctccaccaccaacccctcctcaactccagggacaactcccatccccccagtgctgaccaccaccgcccacacctgcagccaccagcagcacagtgactccctcctctgccctagggac

SEQ ID NO: 18695 - DNA, 17377 bp, Homo sapiens
acccggcccggctccctccctgcccgtccccgtccccccacccgtgccagcccccaggatgggtgccccgagcgcgtgccggacgctggtgttggctctggcggccatgctcgtggtgccgcaggcagagacccagggccctgtggagccgagctgggagaatgcagggcacaccatggatggcggtgccccgacgtcctcgcccacccggcgcgtgagctttgttccacccgtcactgtcttccccagcctgagccccctgaacccggcgcacaatgggcgggtgtgcagcacctggggtgacttccactacaagaccttcgacggcgacgtcttccgcttccctggcctttgcaactacgtgttctctgagcactgccgcgccgcctacgaggacttcaacgtccagctacgccgaggcctagtgggctccaggcctgtggtcacccgtgttgtcatcaaggcccaggggctggtgctggaggcgtccaacggctccgtcctcatcaatgggcagcgggaggagctgccttacagccgcactggcctcctggtggagcagagcggggactacatcaaggtcagcatccggctggtgctgacattcctgtggaacggagaggacagtgccctgctggagctggatcccaaatacgccaaccagacctgtggcctgtgtggggacttcaacggcctcccggccttcaacgagttctatgcccacaacgccaggctgaccccgctccagtttgggaacctgcagaagttggatgggcccacggagcagtgcccggacccgctgcccttgccggccggcaactgcacggacgaggagggcatctgccaccgcaccctgctggggccggcctttgcggagtgccacgcactggtggacagcactgcgtacctggccgcctgcgcccaggacctgtgccgctgccccacctgcccgtgtgccacctttgtggaatactcacgccagtgcgcccacgcggggggccagccgcggaactggaggtgccctgagctctgcccccggacctgccccctcaacatgcagcaccaggagtgtggctcaccctgcacggacacctgctccaacccccagcgcgcgcagctctgcgaggaccactgtgtggacggctgcttctgccccccaggcaggtcttgcacggtgctggatgacatcacgcactctggctgcctgcccctcgggcagtgcccctgcacccacggcggccgcacctacagcccgggcacctccttcaacaccacctgcagctcctgcacctgctccggggggctatggcagtgccaggacctgccgtgccctggcacctgctctgtgcagggcggggcccacatctccacctatgatgagaaactctacgacctgcatggtgactgcagctacgttctgtccaagaaatgtgccgacagcagcttcaccgtgctggctgagctgcggaagtgcggcctgacggacaacgagaactgcctgaaagcggtgacgctcagcctggacggcggggacacggccatccgggtccaagcggacggcggcgtgttcctcaactccatctacacgcagctgcccctgtcggcagccaacatcaccctgttcacaccctcgagcttcttcatcgtggtgcagacaggcctggggctgcagctgctggtgcagctggtgccactcatgcaggtgtttgtcaggctggaccccgcccaccagggccagatgtgcggcctgtgtgggaacttcaaccagaaccaggctgacgacttcacggccctcagcggggtggtggaggccacgggcgcagccttcgccaacacctggaaggcccaggctgcctgtgccaatgccaggaacagctttgaggacccctgctccctcagtgtggagaatgagaactacgcccggcactggtgctcgcgcctgaccgatcccaacagtgccttctcgcgctgccactccatcatcaaccccaagcccttccactcgaactgcatgtttgacacctgcaactgtgagcggagcgaggactgcctgtgcgccgcgctgtcctcctatgtgcacgcctgtgccgccaagggcgtacagctcagcgactggagggacggcgtctgcaccaagtacatgcagaactgccccaagtcccagcgctacgcctacgtggtggatgcctgccagcccacttgccgcggcctgagtgaggccgacgtcacctgcagcgtttccttcgtgcctgtggacggctgcacctgccccgcgggcaccttcctcaatgacgcgggcgcctgtgtgcccgcccaggagtgcccctgctacgctcacggcaccgtgctggctcctggagaggtggtgcacgacgagggcgccgtgtgttcatgtacgggtgggaagctaagctgcctgggagcctctctgcagaaaagcacagggtgtgcagcccccatggtgtacctggactgcagcaacagctcggcgggcacccctggggccgagtgcctccggagctgccacacgctggacgtgggctgtttcagcacacactgcgtgtccggctgtgtctgtcccccggggctggtgtcggatgggagtgggggctgcattgccgaggaggactgcccctgtgtgcacaacgaggccacctacaagcctggagagaccatcagggtcgactgcaacacctgcacctgcaggaaccggaggtgggagtgcagccaccggctctgcctgggcacctgcgtggcctacggggatggccacttcatcacctttgatggcgatcgctacagctttgaaggcagctgcgagtacatcttggcccaggactactgtggggacaacaccacccacgggaccttccgcatcgtcaccgagaacatcccctgtgggaccaccggcaccacctgctccaaggccatcaagctcttcgtggagagctacgagctgatcctccaagaggggacctttaaggcggtggcgagagggccgggtggggacccaccctacaagatacgctacatggggatcttcctggtcatcgagacccacgggatggccgtgtcctgggaccggaagaccagcgtgttcatccgactgcaccaggactacaagggcagggtctgcggcctgtgcgggaacttcgacgacaatgccatcaatgactttgccacgcgtagccggtccgtggtgggggacgcactggagtttgggaacagctggaagctctccccctcctgcccggacgccctggcacccaaggacccctgcacggccaaccccttccgcaagtcctgggcccagaagcagtgcagcatcctccacggccccaccttcgccgcctgccgctcccaggttgactccaccaagtactacgaggcctgcgtgaacgacgcgtgtgcctgcgactcgggtggcgactgcgagtgtttctgcacggctgtggctgcctacgcccaggcctgccacgacgcgggcctgtgtgtgtcctggcggactccggacacctgccccttgttctgtgacttctacaacccacatgggggctgtgagtggcactaccagccctgcggggcaccctgcctaaaaacctgccggaaccccagtgggcactgcctggtggacctgcctggcctggaaggctgctacccgaagtgcccacccagccagcccttcttcaatgaggaccagatgaagtgcgtggcccagtgtggctgctacgacaaggacggaaactactatgacgtcggtgcaagggtccccacagcggagaactgccagagctgtaactgcacacccagtggcatccagtgcgctcacagccttgaggcctgcacctgcacctatgaggacaggacctacagctaccaggacgtcatctacaacaccaccgatgggcttggcgcctgcttgatcgccatctgcggaagcaacggcaccatcatcaggaaggctgtggcatgtcctggaactccagccacaacgccattcaccttcaccaccgcctgggtcccccactccacgacaagcccggccctcccggtctccaccgtgtgtgtccgcgaggtctgccgctggtccagctggtacaatgggcaccgcccagagcccggcctgggaggcggagactttgagacgtttgaaaacctgaggcagagagggtaccaggtatgccctgtgctggctgacatcgagtgccgggcggcgcagcttcccgacatgccgctggaggagctgggccagcaggtggactgtgaccgcatgcgggggctgatgtgcgccaacagccaacagagtcccccgctctgtcacgactacgagctgcgggttctctgctgcgaatacgtgccctgtggcccctccccggccccaggcaccagccctcagccctccctcagtgccagcacggagcctgctgtgcctaccccaacccagaccacagcaaccgaaaagaccaccctatgggtgaccccgagcatccggtcgacggcggccctcacctcgcagactgggtccagctcaggccccgtgacggtcaccccctcggccccaggtaccaccacctgccagccccggtgtcagtggacagagtggtttgatgaggactaccccaagtctgaacaacttggaggggacgttgagtcctacgataagatcagggccgctggagggcacttatgccagcagcctaaggacatagagtgccaggccgagagcttccccaactggaccctggcacaggtggggcagaaggtgcactgtgacgtccacttcggcctggtgtgcaggaactgggagcaggagggcgtcttcaagatgtgctacaactacaggatccgggtcctctgctgcagtgacgaccactgcaggggacgtgccacaaccccgccaccgaccacagagctggagacggccaccaccaccaccacccaggccctgttctcaacgccgcagcctacgagtagcccggggctgaccagggctcccccggccagcaccacagcagtccccaccctctcagaaggactgacatcccccagatacacaagcacccttggtacagccaccacgggaggccccacgacgcctgcaggctccacagaacccactgtcccaggggtggccacatccacccttccaacacgctcagcccttccagggacgacggggagcttgggcacatggcgcccctcacagccacccacgctggccccaacaacaatggcaacctccagagctcgcccgacaggcacagccagcaccgcttccaaagagccgctgaccacgagcctggcgccaacactcacgagcgagctgtccacctctcaggccgagaccagcacgcccaggacagagacgacaatgagccccttgactaacaccaccaccagccagggcacgacccgctgtcaaccgaagtgtgagtggacagagtggtttgacgtggacttcccaacctcaggggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactgccccagtaccccagccaccagctccacggccacgccctcctcaactccggggacgacctggatcctcacaaagccgaccacaacagccactacgactgcgtccactggatccacggccaccccgacctccaccctgagaacagctccccctcccaaagtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccgccacggccaccacaactggggccaccggctctgtggccaccccctcctccaccccaggaacagctcacactaccaaagtgccaactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacggccaccggctccaccaccaacccctcctcaactcctgggacaactcccatccccccagtgctgaccaccaccgccaccacacctgcagccaccagcaacacagtgactccctcctctgccctagggaccacccacacacccccagtgccgaacaccatggccaccacacacgggcgatccctgccccccagcagtccccacacggtgcgcacagcctggacttcggccacctcgggcatcttgggcaccacccacatcacagagccttccacggtgacttcccacaccctagcagcaaccaccggtaccacccagcactcgactccagccctttccagccctcaccctagcagcagaaccaccgagtcacccccttctccagggacgaccaccccgggccacaccacggccacctccaggaccacagccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgaccccctcctccatcccggggaccacccacacccccacagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttctccagggacgaccaccccgggccacaccagggccacctccaggaccacggccacggccacacccagcaagacccgcacctcgaccctgctgcccagcagccccacatcggccccaataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctccactccagggacgacctggatcctcacagagcagaccacagcagccactacgaccgcaaccactggatccacggccatcccgtcctccaccccgggaacagctccccctcccaaagtgctgaccagcacggccaccacacccacagccaccagttccaaagccacttcctcctccagtccaaggactgcaaccacccttccagtgctgacaagcacagccaccaaatccacagctaccagctttacacccatcccctccttcacccttgggaccaccgggaccctcccagaacagaccaccacacccatggccaccatgtccacaatccacccctcctccactccggagaccacccacacctccacagtgctgaccacgaaggccaccacgacaagggccaccagttccatgtccaccccctcctccactccggggacgacctggatcctcacagagctgaccacagcagccactacaactgcagccactggccccacggccaccccgtcctccaccccagggaccacctggatcctcacagagcccagcactacagccaccgtgacggtgcccaccggatccacggccaccgcctcctccacccgggcaactgctggcaccctcaaagtgctgaccagcacggccaccacacccacagtcatcagctccagagccactccctcctccagtccagggactgcaaccgcccttccagcactgagaagcacagccaccacacccacagctaccagcgttacagccatcccctcttcctccctgggcaccgcctggacccgcctatcacagaccaccacacccacggccaccatgtccacagccacaccctcctctactccagagactgtccacacctccacagtgcttaccaccacgaccaccacaaccagggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacagccaccggctccaccaccaacccctcctcaactccagggacaactcccatccccccagtgctgaccaccaccgccaccacacctgcagccaccagcagcacagtgactccctcctctgccctagggaccacccacacacccccagtgccgaacaccacggccaccacacacgggcggtccctgccccccagcagtccccacacggtgcgcacagcctggacttcggccacctcgggcatcttgggcaccacccacatcacagagccttccacggtgacttcccacaccccagcagcaaccaccagtaccacccagcactcgactccagccctgtccagccctcaccctagcagcaggaccaccgagtcacccccttctccagggacgaccaccccgggccacaccaggggcacctccaggaccacagccacagccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggcagtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctcaactccggggacgacctggatcctcacaaagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgcccacacctccacagtgcttaccaccacggccaccacaaccagggccaccggctctgtggccaccccctcttccaccccaggaacagctcacactaccaaagtgccgactaccacaaccacgggcttcacagtcaccccctcctccagcccagggacggcacgcacgcctccagtgtggatcagcacaaccaccacacccacaaccagtggctccacggtgaccccctcctccgtcccggggaccacccacacccccacagtgctgaccaccaccaccacaactgtggccactggttctatggcaacaccctcctctagcacacagaccagtggtactcccccatcactgatcaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttccccagggacgaccaccccgggccacaccacggccacctccaggaccacggccacggccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgggggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgcatccactggatccacggccaccccgtcctccaccccgggaacagctccccctcccaaagtgctgaccagcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggaccctcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacccatcaccccagtgctgaccagcacggccaccacacccgcagccaccagctccaaagccacttcctcctccagtccaaggactgcaaccacccttccagtgctgacaagcacagccacaaaatccacagctaccagctttacacccatcccctcctccaccctgtggaccacgtggaccgtcccagcacagaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttctctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgctgggccccgactggcacaccccccactgccagccccgcagccccggtgtctagcacacccacccccaccccatgcccaccacagccgctctgtgatctgatgctgagccaggtctttgctgagtgccacaaccttgtgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgtggatgagtgtggctgcacgcccttctgtgtccctgcgcccatgagccccccggcctgtgtgtggcaccccgcgctccgtgctcctgctgcccaccttggccttgcccctccctga

SEQ ID NO: 18696 - DNA, 8006 bp, Homo sapiens
ggcagcagcaggcctgccgggcccagcgcgagctcctctccactgtgcaccatggtccagcggtggctgctgctgtcctgctgcggagccctgctcagcgctggtctggctaacacctcctacaccagcccaggcctccagaggctgaaggactctccacagacagccccggacaaaggccagtgctccacgtggggggctggtcacttctccaccttcgaccaccacgtgtacgacttctcggggacgtgcaactacatcttcgcggccacctgcaaggacgccttccccaccttcagtgtccagctgcggcgaggcccagacgggagcatctcgcggatcatcgtggagctgggggcctccgtcgtcactgtgagcgaagccatcatctcagtcaaggacatcggggtcatcagcctgccctataccagcaatggactccagatcacacccttcggccagagcgtgcggctggtggccaagcagctggagctggagctggaagtcgtgtggggtcctgacagccacctcatggttctggtggagcggaagtacatgggtcagatgtgcgggctctgcgggaactttgacgggaaggtgaccaacgagtttgtcagtgaggagggcaagttcctggaaccccacaagtttgctgccctccagaagctggacgaccccggcgagatctgcaccttccaggacatccccagcacccacgtccggcaggcccagcacgcccggatctgcacccagctgctgaccctggtggcccctgagtgcagcgtgtccaaggagcccttcgtgctaagctgccaggcggacgtggccgcagccccccagccaggcccacagaacagcagttgtgccaccctgtcggagtactcccgccagtgcagcatggtgggccagccggtccgccgctggcggagccccggcctgtgctccgtgggtcagtgcccggccaaccaggtgtaccaggagtgcggctcggcctgcgtgaagacctgctccaacccgcagcacagctgctccagctcctgcaccttcgggtgcttctgcccggaaggtacggtcctgaatgacctctccaataaccacacctgcgtgcccgtcacccagtgcccctgtgtgctccacggcgccatgtatgcccccggggaggtcacaatagctgcctgccaaacctgccggtgcaccctgggccgctgggtgtgcacggagcggccgtgccccggacactgctccctggaaggtggctcctttgttaccacatttgacgccaggccctaccgcttccacggcacctgcacctacatcctcctccagagcccccagcttcccgaggacggtgccctcatggctgtgtacgacaagtccggcgtctcacactccgagacctccctggtggctgtggtctacctctccaggcaggacaaaattgtgatctctcaggacgaggtggtcaccaacaacggagaagccaagtggctgccatacaagactcgcaacatcacggtcttcaggcagacgtccacccacctccagatggccaccagcttcgggctggagctcgtggtccagctgcgccccatcttccaggcctatgtcactgttgggccccagttcagaggtcagaccagagggctctgcggcaacttcaacggggacacaacggatgacttcaccactagcatgggtatcgccgagggcaccgcctcgctgtttgtggactcctggcgggcggggaactgtccggccgctctggagcgtgagactgacccctgctccatgagccagctcaacaaggtgtgtgcagagacccactgctccatgctgctgaggacaggcacggtgttcgagaggtgccacgccacagtgaaccctgcacccttctacaagaggtgcgtgtaccaggcctgcaactacgaggagacctttccccacatctgtgccgccctgggcgactacgtacacgcctgctccttgcggggcgtcctgctctggggctggagaagcagtgtggacaactgcaccatcccctgcacgggtaacaccaccttcagctacaacagccaagcctgtgagcgcacctgcctgtcgctgtcggaccgtgccaccgagtgccaccacagcgccgtgcccgtggacggttgcaactgccccgatggcacctacctgaaccaaaagggcgagtgtgtgcgcaaggcccagtgcccgtgcatactggagggttacaagttcatcctggccgagcagtccactgtcatcaacggcatcacctgccactgcatcaacgggcggctgagttgcccgcagcggccacagatgttcctggcctcctgccaggcccctaagaccttcaagtcctgcagccagtcctccgagaacaagtttggggcagcctgtgcccccacatgccagatgctggccaccggtgttgcctgcgtgcccaccaagtgtgagcctggctgtgtctgcgccgagggcctctacgagaatgccgacgggcagtgtgtgccccccgaggagtgcccatgtgagttctcgggggtctcctaccctggaggagctgagctccacactgactgcaggacctgctcctgctcaagggggaggtgggcctgtcagcagggcacccactgcccatccacctgcaccctctacggggagggccacgtcatcaccttcgacggccagcgcttcgtattcgacggcaactgcgagtacatcctggccacggacgtctgtggtgtcaacgactcacagcccaccttcaagatcctgacagagaacgtcatctgtgggaactccggggtcacatgctcacgggccatcaagatcttcctggggggcctgtccgtggtgctggcggacagaaactacacggtcaccggggaggagccccacgtgcagctcggggtgacgccgggtgcgctgagccttgtcgtggacatcagcatccccgggaggtacaacctgacgctcatctggaacaggcacatgaccatcctcatcaggatcgcccgtgcctcccaggatcccctctgcggcttgtgtggcaacttcaacgggaacatgaaggacgacttcgagacgcgcagcaggtacgtggcatccagcgagctggagttggtgaactcgtggaaggagagcccgctgtgcggggacgtgagcttcgtgacagacccctgcagtctcaatgccttccggcgctcctgggccgagcgcaagtgcagcgtcatcaacagccagacctttgccacctgccacagcaaggtataccacctgccctactacgaggcctgcgtgcgcgacgcatgtgggtgtgacagtggcggggactgtgagtgtctgtgcgatgccgtggctgcctacgcccaagcctgtctggacaagggtgtgtgcgtggactggaggaccccggccttctgccccatctactgcggcttctacaacacgcacacgcaggacggccatggcgagtaccagtacacacaggaggccaactgcacgtggcactaccagccctgcctctgccccagccagccacagagcgtcccaggcagcaacatcgaaggctgctacaactgctcccaggatgagtacttcgaccacgaggagggggtgtgcgtgccctgcatgccgcccaccacgccgcagccacccaccacgccgcagctgcccaccacaggctcacggcccacgcaagtctggcccatgacgggaacctccaccaccatcgggcttctcagctccaccggaccctcacccagctctaatcacacccctgccagccccacccagacacccctccttccagccacgctcacatcctccaagcccacagcctcctcgggagaaccacctagaccaaccacggccgtcaccccacaagccacatcagggctgcctcccacagccacactgagatcgacagccacaaaacccacagtgacccaggccacaaccagggccacggcgtcgaccgccagcccagccacgacgtccacagctcagtccacaacacggaccacaatgacactaccaaccccagccacatcagggacaagccccacgctgccaaaatcgaccaatcaggaactgccaggaacaacggccacccagacgacaggcccacgtccaaccccagcaagcaccacaggcccaaccaccccacagccaggacaacccacgaggcccacagccacagagaccactcaaacaagaacgactactgaatacacaacgccccaaaccccacacaccacacactccccgcctacggcggggagtcccgtcccttccacaggtcctgtcactgcaacatctttccatgccaccactacctatccaaccccatcacaccctgagaccacacttcccactcacgttccacctttctccacctccttggtgactccaagtactcacacagtcatcacccctacccacgcacagatggccacatctgcctccaaccactcagcgccaacaggtaccattcctccaccaacaacgctcaaggccacagggtccacccacacagccccaccaataacgccgaccaccagtgggaccagccaagcccacagctcattcagcacaaacaaaacacctacctcgctacattcacacacttcctccacacaccatcctgaagtcaccccaacttctactaccacgattactcccaaccccactagtacacgcaccagaacccctgtggcccacaccaactcagccaccagcagcaggccaccaccacccttcaccacacactccccacctacagggagcagtcccttctcttccacaggtcccatgacggcaacatccttcaagaccaccactacctatccaaccccatcacaccctcagaccacacttcccactcacgttccacctttctccacctctttggtgactccaagtactcacacagtcatcacccctacccatgcacagatggccacttctgcctccatccactcaatgccaacaggcacgattcctccaccgacaacgctcaaggccacagggtccacccacacagcgccaacaatgacgctgaccaccagcgggaccagccaagccctgagctcattaaacacagccaaaacctctacatccctacattcacacacttcctccacacaccatgctgaagccacctcaacttctaccaccaacatcacccccaaccccaccagtacaggaaccccaccaatgacagtgaccaccagtgggaccagccaatcccgaagctcatttagcacggccaaaacctctacatccctacattcacacacttcctccacacaccatcctgaagtcacctcaacttctaccaccagcatcacccccaaccacaccagtacaggcaccagaacccctgtggcccacaccacgtcggccaccagcagcaggctacccacacccttcaccacacactccccacctacagggaccactcccatctcttccacaggtcctgtcactgcaacatccttccagaccaccactacctatccaaccccatcacaccctcacaccacacttcccactcacgttccatctttctccacctccttggtgactccaagtactcacacggtcatcatccctacccacacacagatggccacttctgcctccatccactcaatgccaacaggcaccattcctccaccgaccacgatcaaggccacagggtccacccacacagccccaccaatgacaccgaccaccagtgggaccagccaatccccaagctcatttagcacggccaaaacttctacatccctaccttaccacacttcctcaacacaccatcctgaagtcaccccaacttctaccaccaacatcacccccaaacacaccagtacaggcaccagaacccctgtggcccacaccacctcggccagcagcagcaggctacccacacccttcaccacacactccccacctacagggagcagtcccttctcttccacaggtcctatgactgcaacatccttccagaccaccactacctatccaaccccatcacaccctcagaccacacttcccactcacgttccacctttctccacctccttggtgactccaagtactcacacagtcatcatcactacccacacacagatggccacttctgcctccatccactcaacgccaacaggcaccgttcctccaccaacaacgctcaaggccacagggtccacccacacagccccaccaatgacagtgaccaccagtgggaccagccaaacccacagctcattcagcacagctacagcctcttcttccttcatatcctcctcgtcttggctgcctcagaactctagctcaaggccaccgtcatcacctatcaccacacaactcccccacttgagttctgcaaccactcctgtttccacaactaatcagctgtcctcctcattttctcccagtccttctgccccctctactgtttcttcttatgtgccctcctcccactcctctccccagacttcatcgccttctgttggcacatcttcctctttcgtgtccgcccccgtgcactccacaaccctgagctcggggtcacactcctcattgtccactcatcccacgactgcatcagtgtctgcatctcctctttttccttcttctccagctgcctctactaccattagggccactctcccccacactatctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggggtctgcagtgtgcgggagcagcaggaggagatcacgttcaaggggtgcatggcgaacgtgacggtaacccgctgtgagggcgcctgcatttccgctgccagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctgtggcctgtggagactagcagggtcgctgcctgctctcctggggctgaaggactgcagatgacagacaggaaaacacccaccagcccccttcccgcttgtgccagcagctgctttcctggtcaccaggcctggcccccaagtgccctgggccgtggctccctggggcaccggttggagaggggctgccaagcaggggctcagactaccacactcctgcagaccctgagccagcagagagggactgaggcggacagtggtcacggacctcccaggcacacagggcactcccgaccacccctgcccaccgtccaacacctcccagcccctgaacttggccccagccctgctgggcccagaaccctgcagatgaagccacagagcaggcgctcgaccagacccatcaggggcgaggagggcacggaaacctgtgccgagatgggggcaagaggcccaggcagccaccagcacagagaagaggagatccccagagtcagggagggcagagggtggcagcgagggcagggcagccgcccccgctcccagccaggcagaaggcccccaccagcaccacacccatccccagcagcctgtccttgggagagggcgtcacccggtcagagactccaaataaaccggttcttgtcaaggcaca

SEQ ID NO: 18697 - DNA, 2443 bp, Homo sapiens
ttatcttaaatctaatagatttcctatttccaaaaagctcgactggagtgttataaaacctgaaaattctcttgtgctttctcttcttttgcttctagttaccatcctcaaaggattggctaaaagcaagcaactggattgaacaccctaagaagaaagattcacactgcaccaggagacatcagaaagaatgaaaactctgccgctgtttgtgtgcatctgtgcactgagtgcttgcttctcgttcagtgaaggtcgagaaagggatcatgaactacgtcacagaaggcatcatcaccaatcacccaaatctcactttgaattaccacattatcctggactgctagctcaccagaagccgttcattagaaagtcctataaatgtctgcacaaacgctgtaggcctaagcttccaccttcacctaataacccccccaaattcccaaatcctcaccagccacctaaacatccagataaaaatagcagtgtggtcaaccctaccttagtggctacaacccaaattccatctgtgactttcccatcagcttccaccaaaattactacccttccaaatgtgacttttcttccccagaatgccaccaccatatcttcaagagaaaatgttaacacaagctcttctgtagctacattagcaccagtgaattccccagctccacaagacaccacagctgccccacccacaccttctgcaactacaccagctccaccatcttcctcagctccaccagagaccacagctgccccacccacaccttctgcaactacacaagctccaccatcttcctcagctccaccagagaccacagctgccccacccacacctcctgcaactacaccagctccaccatcttcctcagctccaccagagaccacagctgccccacccacaccttctgcaactacaccagctccactatcttcctcagctccaccagagaccacagctgtcccacccacaccttctgcaactaccctagacccatcatccgcctcagctccaccagagaccacagctgccccacccacaccttctgcaactacaccagctccaccgtcttccccagctccacaagagaccacagctgccccaattaccacacctaattcttccccaactactcttgcacctgacacttctgaaacttcagctgcacccacacaccagactactacttcggtcactactcaaactactactactaaacaaccaacttcagctcctggccaaaataaaatttctcgatttcttttatatatgaagaatctactaaacagaattattgacgacatggtggagcaatagtatattgtatgttgtaaagtgttctgtcatttacaagatgtgattcatgagtgcagaactaccacctttcttttagcaccaatcccaacatgaaattatattactcagatttaaagcactatcattaatctttcaatctaattattcaccaccacaagacctattaacaagacaaaatgcctctatcccacaagccagatgcaggtctggggttcaaaataactctttggatcctacagagatagcctactgagggcaaagaaagtccttagataaagagagaatattgtatgggccatcaaccatttacttttccctgaatgttagaaactacaaaaccactaccttgtacccccatcaaaatcccacctgaaccatctaatcctataaacataaaggggtaaaattggaactctccagatgaacaaagacatctaaatatctgtagatagaaacatttatctatctaaatatattgatagacctgtcattgtattgattaatgacaaaaccctttagataattatcttccattttaaataaaattttatttcacaaatatgagccaagaaagaggaaagttgatttgaagtgaggattagaagtgaatgacaataaagtctgtcagccaagcacgaaccaagactggcactatttttcttagtgtatataattgtttaaactgcaaggttgacatttattgtgttgtgtctaagttaatttcgatctaatgtacctgattctagcctctgtgaacaacaagaatatgtttgtgtatgttcacatggtgcttataatatttcactatcaattcaattaattcacataaattccatgtgaaatgtattcaacaatggaatattttctaaaacatttagtatacatttgaatgtattttaaaccatgccaaactactgctttaatgtcaagtttgcagaattgtctctgaaaataaaaaccctgactttagttgtaaaacaataaaagttagctacttggtatacggagatgttaatttgggatatggaggcatttttatcttctgtcactactacttaaaactctgatgattatgttagatttttttgctaactaataaagatttcaaatggcaattta

SEQ ID NO: 18698 - DNA, 2540 bp, Homo sapiens
actcaattacagtatttcctattcctaaaagaatctagtaggaaggctataagaaatgttctcttactgatccttcttatttgccaccttagattttaagttgcttcttggctaccaaaatgcctagacacagtaactaacaagaattcaactgacaagtagtttgaccagacttggaggaaggattccttcaaagttaccatcctcaaaggattggctaaaagcaagcaactggattgaacaccctaagaagaaagattcacactgcaccaggagacatcagaaagaatgaaaactctgccgctgtttgtgtgcatctgtgcactgagtgcttgcttctcgttcagtgaaggtcgagaaagggatcatgaactacgtcacagaaggcatcatcaccaatcacccaaatctcactttgaattaccacattatcctggactgctagctcaccagaagccgttcattagaaagtcctataaatgtctgcacaaacgctgtaggcctaagcttccaccttcacctaataacccccccaaattcccaaatcctcaccagccacctaaacatccagataaaaatagcagtgtggtcaaccctaccttagtggctacaacccaaattccatctgtgactttcccatcagcttccaccaaaattactacccttccaaatgtgacttttcttccccagaatgccaccaccatatcttcaagagaaaatgttaacacaagctcttctgtagctacattagcaccagtgaattccccagctccacaagacaccacagctgccccacccacaccttctgcaactacaccagctccaccatcttcctcagctccaccagagaccacagctgccccacccacaccttctgcaactacacaagctccaccatcttcctcagctccaccagagaccacagctgccccacccacacctcctgcaactacaccagctccaccatcttcctcagctccaccagagaccacagctgccccacccacaccttctgcaactacaccagctccactatcttcctcagctccaccagagaccacagctgtcccacccacaccttctgcaactaccctagacccatcatccgcctcagctccaccagagaccacagctgccccacccacaccttctgcaactacaccagctccaccgtcttccccagctccacaagagaccacagctgccccaattaccacacctaattcttccccaactactcttgcacctgacacttctgaaacttcagctgcacccacacaccagactactacttcggtcactactcaaactactactactaaacaaccaacttcagctcctggccaaaataaaatttctcgatttcttttatatatgaagaatctactaaacagaattattgacgacatggtggagcaatagtatattgtatgttgtaaagtgttctgtcatttacaagatgtgattcatgagtgcagaactaccacctttcttttagcaccaatcccaacatgaaattatattactcagatttaaagcactatcattaatctttcaatctaattattcaccaccacaagacctattaacaagacaaaatgcctctatcccacaagccagatgcaggtctggggttcaaaataactctttggatcctacagagatagcctactgagggcaaagaaagtccttagataaagagagaatattgtatgggccatcaaccatttacttttccctgaatgttagaaactacaaaaccactaccttgtacccccatcaaaatcccacctgaaccatctaatcctataaacataaaggggtaaaattggaactctccagatgaacaaagacatctaaatatctgtagatagaaacatttatctatctaaatatattgatagacctgtcattgtattgattaatgacaaaaccctttagataattatcttccattttaaataaaattttatttcacaaatatgagccaagaaagaggaaagttgatttgaagtgaggattagaagtgaatgacaataaagtctgtcagccaagcacgaaccaagactggcactatttttcttagtgtatataattgtttaaactgcaaggttgacatttattgtgttgtgtctaagttaatttcgatctaatgtacctgattctagcctctgtgaacaacaagaatatgtttgtgtatgttcacatggtgcttataatatttcactatcaattcaattaattcacataaattccatgtgaaatgtattcaacaatggaatattttctaaaacatttagtatacatttgaatgtattttaaaccatgccaaactactgctttaatgtcaagtttgcagaattgtctctgaaaataaaaaccctgactttagttgtaaaacaataaaagttagctacttggtatacggagatgttaatttgggatatggaggcatttttatcttctgtcactactacttaaaactctgatgattatgttagatttttttgctaactaataaagatttcaaatggcaattt

SEQ ID NO: 18699 - DNA, 2479 bp, Homo sapiens
actgttccactactcatcaagcacataagttactcattgagaacctctgatcgtcactgtgctcatcaggaagaaattgatgcacaaagaactactgtcaatctcagcaaaccacaactattcttttctttaaaattaccatcctcaaaggattggctaaaagcaagcaactggattgaacaccctaagaagaaagattcacactgcaccaggagacatcagaaagaatgaaaactctgccgctgtttgtgtgcatctgtgcactgagtgcttgcttctcgttcagtgaaggtcgagaaagggatcatgaactacgtcacagaaggcatcatcaccaatcacccaaatctcactttgaattaccacattatcctggactgctagctcaccagaagccgttcattagaaagtcctataaatgtctgcacaaacgctgtaggcctaagcttccaccttcacctaataacccccccaaattcccaaatcctcaccagccacctaaacatccagataaaaatagcagtgtggtcaaccctaccttagtggctacaacccaaattccatctgtgactttcccatcagcttccaccaaaattactacccttccaaatgtgacttttcttccccagaatgccaccaccatatcttcaagagaaaatgttaacacaagctcttctgtagctacattagcaccagtgaattccccagctccacaagacaccacagctgccccacccacaccttctgcaactacaccagctccaccatcttcctcagctccaccagagaccacagctgccccacccacaccttctgcaactacacaagctccaccatcttcctcagctccaccagagaccacagctgccccacccacacctcctgcaactacaccagctccaccatcttcctcagctccaccagagaccacagctgccccacccacaccttctgcaactacaccagctccactatcttcctcagctccaccagagaccacagctgtcccacccacaccttctgcaactaccctagacccatcatccgcctcagctccaccagagaccacagctgccccacccacaccttctgcaactacaccagctccaccgtcttccccagctccacaagagaccacagctgccccaattaccacacctaattcttccccaactactcttgcacctgacacttctgaaacttcagctgcacccacacaccagactactacttcggtcactactcaaactactactactaaacaaccaacttcagctcctggccaaaataaaatttctcgatttcttttatatatgaagaatctactaaacagaattattgacgacatggtggagcaatagtatattgtatgttgtaaagtgttctgtcatttacaagatgtgattcatgagtgcagaactaccacctttcttttagcaccaatcccaacatgaaattatattactcagatttaaagcactatcattaatctttcaatctaattattcaccaccacaagacctattaacaagacaaaatgcctctatcccacaagccagatgcaggtctggggttcaaaataactctttggatcctacagagatagcctactgagggcaaagaaagtccttagataaagagagaatattgtatgggccatcaaccatttacttttccctgaatgttagaaactacaaaaccactaccttgtacccccatcaaaatcccacctgaaccatctaatcctataaacataaaggggtaaaattggaactctccagatgaacaaagacatctaaatatctgtagatagaaacatttatctatctaaatatattgatagacctgtcattgtattgattaatgacaaaaccctttagataattatcttccattttaaataaaattttatttcacaaatatgagccaagaaagaggaaagttgatttgaagtgaggattagaagtgaatgacaataaagtctgtcagccaagcacgaaccaagactggcactatttttcttagtgtatataattgtttaaactgcaaggttgacatttattgtgttgtgtctaagttaatttcgatctaatgtacctgattctagcctctgtgaacaacaagaatatgtttgtgtatgttcacatggtgcttataatatttcactatcaattcaattaattcacataaattccatgtgaaatgtattcaacaatggaatattttctaaaacatttagtatacatttgaatgtattttaaaccatgccaaactactgctttaatgtcaagtttgcagaattgtctctgaaaataaaaaccctgactttagttgtaaaacaataaaagttagctacttggtatacggagatgttaatttgggatatggaggcatttttatcttctgtcactactacttaaaactctgatgattatgttagatttttttgctaactaataaagatttcaaatggcaattt

SEQ ID NO: 18700 - DNA, 635 bp, Homo sapiens
actgttccactactcatcaagcacataagttactcattgagaacctctgatcgtcactgtgctcatcaggaagaaattgatgcacaaagaactactgtcaatctcagcaaaccacaactattcttttctttaaaattaccatcctcaaaggattggctaaaagcaagcaactggattgaacaccctaagaagaaagattcacactgcaccaggagacatcagaaagaatgaaaactctgccgctgtttgtgtgcatctgtgcactgagtgcttgcttctcgttcagtgaaggtcgagaaagggatcatgaactacgtcacagaaggcatcatcaccaatcacccaaatctcactttgaattaccacattatcctggactgctagctcaccagaagccgttcattagaaagtcctataaatgtctgcacaaacgctgtaggcctaagcttccaccttcacctaataacccccccaaattcccaaatcctcaccagccacctaaacatccagataaaaatagcagtgtggtcaaccctaccttagtggctacaacccaaattccatctgtgactttcccatcagcttccaccaaaattactacccttccaaatgtgacttttcttccccagaatgcc

SEQ ID NO: 18701 - DNA, 2097 bp, Homo sapiens
cacgtgaccgaggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgccccccagcgacgatctcaccctcttggaaagcagctccagttacaagaacctcacgctcaaattccacaagctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggagacaacagcttccggctcctgtttgacgtggtggtcatcctcacctgctccctgtccttcctcctctgcgcccgctcactccttcgaggcttcctgctgcagaacgagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaatgtgtcgttttcattttt

SEQ ID NO: 18702 - DNA, 2332 bp, Homo sapiens
cacgtgaccgaggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgccccccagcgacgatctcaccctcttggaaagcagctccagttacaagaacctcacgctcaaattccacaagtactgcctgctcactcgaggggggcccagggtgggggaggcagcacactaggcactctcaccccagcaactacttccctaaggtggggacagggcccccccgcccgcgctggtgcctgctgggtgagcacttcccctgccagctgcagagtcagcacgtggcaggggacgctggcacttggggccggaagggacccgaagacgcccctgaccctcacccgagcctcctgcctaggctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggagacaacagcttccggctcctgtttgacgtggtggtcatcctcacctgctccctgtccttcctcctctgcgcccgctcactccttcgaggcttcctgctgcagaacgagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaatgtgtcgttttcattttt

SEQ ID NO: 18703 - DNA, 2869 bp, Homo sapiens
gagtcggccgtgaacggtgtttcctgttccgaatcccgagagccctggaaagttttgaaggaggaggcatggcccggcagccttatcgttttccccaggcaaggattccggagagaggatcaggtgttttcaggttaaccgtcagaaatgcaatggcacatcgtgattctgagatgaaagaagaatgtctaagggaagacctgaagttttacttcatgagcccttgtgaaaaataccgagccagacgccagattccgtggaaactgggtttgcagattttgaagatagtcatggtcaccacacagcttgttcgttttggtttaagtaaccagctggtggttgctttcaaagaagataacactgttgcttttaagcacttgtttttgaaaggatattctggtacagatgaagatgactacagctgcagtgtatatactcaagaggatgcctatgagagcatcttttttgctattaatcagtatcatcagctaaaggacattaccctggggacccttggttatggagaaaatgaagacaatagaattggcttaaaagtctgtaagcagcattacaagaaagggaccatgtttccttctaatgagacactgaatattgacaacgacgttgagctcgattgtgttcaattagaccttcaggacctctccaagaagcctccggactggaagaactcatcattcttcagactggaattttatcggctcttacaggttgaaatctcctttcatcttaaaggcattgacctacagacaattcattcccgtgagttaccagactgttatgtctttcagaatacgattatctttgacaataaagctcacagtggcaaaatcaaaatctattttgacagtgatgccaaaattgaagaatgtaaagacttgaacatatttggatctactcagaaaaatgctcagtatgtcctggtgtttgatgcatttgtcattgtgatttgcttggcatctcttattctgtgtacaagatccattgttcttgctctaaggttacggaagagatttctaaatttcttcctggagaagtacaagcggcctgtgtgtgacaccgaccagtgggagttcatcaacggctggtatgtcctggtgattatcagcgacctaatgacaatcattggctccatattaaaaatggaaatcaaagcaaagaatctcacaaactatgatctctgcagcatttttcttggaacctctacgctcttggtttgggttggagtcatcagatacctgggttatttccaggcatataatgtgctgattttaacaatgcaggcctcactgccaaaagttcttcggttttgtgcttgtgctggtatgatttatctgggttacacattctgtggctggattgtcttaggaccataccatgacaagtttgaaaatctgaacacagttgctgagtgtctgttttctctggtcaacggtgatgacatgtttgcaacctttgcccaaatccagcagaagagcatcttggtgtggctgttcagtcgtctgtatttatattccttcatcagcctttttatatatatgattctcagtctttttattgcacttattacagattcttatgacaccattaagaaattccaacagaatgggtttcctgaaacggatttgcaggaattcctgaaggaatgcagtagcaaagaagagtatcagaaagagtcctcagccttcctgtcctgcatctgctgtcggaggaggaaaagaagtgatgatcacttgatacctattagctaaagttctgctaaagatgattaaagttcaggcatccttatccagcggctgagcagaggaaccccaaatgacttggacaagcagttccaaaatgactctcttatttaattgtggagtgggaaagaggactcacagttagccagctgaccatgactgaagttccagctttactttttataaacttgaatgataaagaatagaccatgggctactactgggcattagtgcaatataacagcgataataaaattctctattagtctgttaatttatgacatgatctcggaatggaaaaagatcatttcagagtgtgcgaaataatagtctttaaccatgtaattaaatatgtgtgtttattgtcaaataaggatttgttttaaaggtgattcttgggtttgaagacatttgttaattcatggtctgtacagaaatgaagctggttgcaataccaatctagagagtccaagctggtgaactattaagctgtttaaagatcacccttggcctggcacagtggttcacacctgtaatcccagcactttgggaggcctaggcaggcagactgagctcaggagcttgagaccagcctgggcaacatggcaaaaacccacctctacaaaaagtacaaaaattagtcgggcgtgatggcaggcatctgtagtcccagctacttgggaagctgaagtgggaggatcacctgagctctggaggtggaggctgccatgagccatgatcgtgccactacactccagcctgggtgacagagtgagatcctgtctcaaaaaaaaaaaaaaatcacccttaaatcaacaaaaagacctcatgctcatgcagtggacatttcttggcctgttttcctgtgggttttcttcagcatgatatgaagcaactgttggcatagccagtgggataaataagaaatggaatcatttggctgcctcgtcacttgtgctaatggtcagttgtacacacatgacatgtggaagtgacctgtagcagcggtcactcattttaacaattgaactctgctgggttgggtatttacctttgtctagaaaagaaatatgatatattttctctaaataaatttattttcatcattc

SEQ ID NO: 18704 - DNA, 2795 bp, Homo sapiens
cggggctcgaggctgctggagtcgctcgctgactcgccctgcgccctcgccgcggacaccggagctgcggccgctccccgctgtcccccagagatggcagatcctgaggtagttgtgagtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagctggtcttatttgggctaagtaaccagatggtggtagctttcaaggaagagaatactatagcattcaaacaccttttcctaaaaggatatatggaccgaatggatgacacatatgcagtgtacacacaaagtgacgtgtatgatcagttaatcttcgcagtaaaccagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactgagtgtttctttgtggagccagatgaaccttttcacattgggacaccagcagaaaataaactgaacttaacactggacttccacagactcctaacagtggagcttcagtttaaactgaaagccattaatctgcagacagttcgtcatcaagaactccctgactgttatgactttactctgactataacatttgacaacaaggcccatagtggaagaattaaaataagtttagataatgacatttccatcagagaatgtaaagactggcatgtatctggatcaattcagaagaacactcattacatgatgatctttgatgcctttgtcattctgacttgcttggtttcattaatcctctgcattagatctgtgattagaggacttcagcttcagcaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaagagtctaactagttatgatgtctgtagcatacttcttgggacttctaccatgctcgtgtggcttggagtcatccgatacctcggtttctttgcaaagtacaacctcctcattttgacccttcaggcagcgctgcccaatgtcatcaggttctgctgctgtgcagctatgatttacttaggttactgcttctgtggatggatcgtgctggggccttaccatgacaagtttcgttctctgaacatggtctctgagtgccttttctctctgataaatggagatgatatgtttgccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgtttatatttttaaaagcaatatttaatgtctttgcaactttatgctgggattgtttttaaaaaaactttaatgaggaaagctattggattattattatttcttgtttattttgccatggctttagaatgtattctgtatgcctctcttttgctctgatactgttgctcctgctattctgattgtgcagactgtgtaattagtggaaaacaatccttggtctgactgtgactttggacaactcagtaaccctggcttggaccactctcaggagtccatccttgagagagtgggtgtagttatcatttatacagtaatcattgcattttaaaatcttctcttgaaaggaagaataagagtgcaccagaataagagcgcaccagaataagagcgcaccagctaacaatgtgatacggccatatgtcacttaaggatggagatatgttctgagaaatgtgtcattaggcgattttgtcattaaacatcatagcatgtacttccacaaacctagatggtatagcctactacacacctaggctatttggtatagcctgttggtcctggggtacaaatctgtacaacatgttactgtattgaatacagtaggcaattgtaacacaatggtaagtatctaaacatagaaaagggacagtaaaaatatggttttataatcttctgggaccaccattgtatatgcggtacatcattgaccaaaacatcgttatccagcatatgactgtatttggttatgaaagccaactgttacttgattctgcttttagttcttaagaggatcaggcttttaaatactcatttacaagttttctatcctccttcagtgttaaagtagaaagtaaaaagagtatcttatacatgcatgaaattaaagcatataccaaatgc

SEQ ID NO: 18705 - DNA, 1760 bp, Homo sapiens
gcgccctcgccgcggacaccggagctgcggccgctccccgctgtcccccagatggcagatcctgaggtagttgtgagtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactgagtgtttctttgtggagccagatgaaccttttcacattgggacaccagcagaaaataaactgaacttaacactggacttccacagactcctaacagtggagcttcagtttaaactgaaagccattaatctgcagacagttcgtcatcaagaactccctgactgttatgactttactctgactataacatttgacaacaaggcccatagtggaagaattaaaataagtttagataatgacatttccatcagagaatgtaaagactggcatgtatctggatcaattcagaagaacactcattacatgatgatctttgatgcctttgtcattctgacttgcttggtttcattaatcctctgcattagatctgtgattagaggacttcagcttcagcaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaagagtctaactagttatgatgtctgtagcatacttcttgggacttctaccatgctcgtgtggcttggagtcatccgatacctcggtttctttgcaaagtacaacctcctcattttgacccttcaggcagcgctgcccaatgtcatcaggttctgctgctgtgcagctatgatttacttaggttactgcttctgtggatggatcgtgctggggccttaccatgacaagtttcgttctctgaacatggtctctgagtgccttttctctctgataaatggagatgatatgtttgccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgtttatatttttaaaagcaatatttaatgtctttgcaactttatgctgggattgtttttaaaaaaactttaatgagg

SEQ ID NO: 18706 - DNA, 2953 bp, Homo sapiens
tggagtcgctcgctgactcgccctgcgccctcgccgcggacaccggagctgcggccgctccccgctgtcccccagcttactccaatcaagcctctgcccgccaggaacaggtaacctgtgtgtgtccgtttgctccttctaagagcatgcctgatagatacttcggtagcctctccggatggccccttcgtcgggtagcctctcctgatggggtccttcgcccaccctgcctcccgcgccggcgctccgggtgaatgtcaagggtggctggctgcgaatacctccttcagctgctggggttcccgacagtttgcagtttttaaaagtgcaccctcggaagggcttttcagactgggtaaacctgacttttccaagagatggcagatcctgaggtagttgtgagtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagctggtcttatttgggctaagtaaccagatggtggtagctttcaaggaagagaatactatagcattcaaacaccttttcctaaaaggatatatggaccgaatggatgacacatatgcagtgtacacacaaagtgacgtgtatgatcagttaatcttcgcagtaaaccagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactgagtgtttctttgtggagccagatgaaccttttcacattgggacaccagcagaaaataaactgaacttaacactggacttccacagactcctaacagtggagcttcagtttaaactgaaagccattaatctgcagacagttcgtcatcaagaactccctgactgttatgactttactctgactataacatttgacaacaaggcccatagtggaagaattaaaataagtttagataatgacatttccatcagagaatgtaaagactggcatgtatctggatcaattcagaagaacactcattacatgatgatctttgatgcctttgtcattctgacttgcttggtttcattaatcctctgcattagatctgtgattagaggacttcagcttcagcaggtagggaacgttgctttctaggaatgctactgacattttgattgacagagacattcactgtgcctcccctcttttccctaaaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaaggtaatttttttcctaatcatgctattgttagtgtcagatttgcactaatggtaatgtatttttccagaatgtaagaattttcagaatgaattgtttcttccaaactgtatatcaagtagacttgaaattggtaatggtaattttcttaaatctagtcaggaggtctcttaggcagagtttttcaaagtgtgatccacaaaccattgcatcagaatcattgggtgcctggtaaagtgtaccatgttagacctactgaattcagactcttcggcggggcctgtgaattcttacacacaccaaaattcatacacaaccaaggtaactaaggtaagagttttttttttttttttaatcttacaagaaatgctcgaatctttaacaaaaatgagtggggctataggggaaagtgaggtcaaggcactatggtgtgcatgcttgcatttgtttcctccgtccattcaaagtgagaatgctcccattttcttactttaccattgatgtgctacaagcttatttattttaagactaacctagcctaaaaatcaactgtccccacaaaataaaaatcacattaaaaaaactaatagtgttcagactaatcttgctcaaacttatgtttccctagtcttgatgcaactgattgagtcacctggggagttggttataaacctgggcagagaccccaaatgcaatggctcagagaagataggagcttatttctgtcttatgcaatagtcagaatgggttttacagactggtgagtagctcaacatctcacagtcattcaggcacccatgttcctcccattttgtttctctgccaccccttaaggacttgccctgactgcatgattattgccgtgttgcctcaaacaggttgcagcttatgggaagcaaaaacacggtatggtagaagctctcccatagactgatggcttggctcaagagtggccgactttatttctgtacatatcccactggatagaatttagtcaatcctaactgcagagggagccagggaacacagcccaggcatgtgcctaggaaggggagaatgggtttaggttgacacttagcagctgccactatatgtggctatagtatgtatcattggaatagatgtttaactttagggacaaataaaaaaccaaaacaaaaaaaggagtaaggggagagatttgcagcaaatctttatttttaccaacctcaactatcattaatttcagtgaaccctaaatggtatccaacaaaatatctttctagaccattcaccgtctctgcctcatagatgatcatatcatgttttcttctcttctgaaacctctaatacccttgtcctatcctcattctaagctgatgaccttacttcctatttcacaaaaataatagaaaaaaaaaa

SEQ ID NO: 18707 - DNA, 2627 bp, Homo sapiens
cggggctcgaggctgctggagtcgctcgctgactcgccctgcgccctcgccgcggacaccggagctgcggccgctccccgctgtcccccagagatggcagatcctgaggtagttgtgagtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactgagtgtttctttgtggagccagatgaaccttttcacattgggacaccagcagaaaataaactgaacttaacactggacttccacagactcctaacagtggagcttcagtttaaactgaaagccattaatctgcagacagttcgtcatcaagaactccctgactgttatgactttactctgactataacatttgacaacaaggcccatagtggaagaattaaaataagtttagataatgacatttccatcagagaatgtaaagactggcatgtatctggatcaattcagaagaacactcattacatgatgatctttgatgcctttgtcattctgacttgcttggtttcattaatcctctgcattagatctgtgattagaggacttcagcttcagcaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaagagtctaactagttatgatgtctgtagcatacttcttgggacttctaccatgctcgtgtggcttggagtcatccgatacctcggtttctttgcaaagtacaacctcctcattttgacccttcaggcagcgctgcccaatgtcatcaggttctgctgctgtgcagctatgatttacttaggttactgcttctgtggatggatcgtgctggggccttaccatgacaagtttcgttctctgaacatggtctctgagtgccttttctctctgataaatggagatgatatgtttgccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgtttatatttttaaaagcaatatttaatgtctttgcaactttatgctgggattgtttttaaaaaaactttaatgaggaaagctattggattattattatttcttgtttattttgccatggctttagaatgtattctgtatgcctctcttttgctctgatactgttgctcctgctattctgattgtgcagactgtgtaattagtggaaaacaatccttggtctgactgtgactttggacaactcagtaaccctggcttggaccactctcaggagtccatccttgagagagtgggtgtagttatcatttatacagtaatcattgcattttaaaatcttctcttgaaaggaagaataagagtgcaccagaataagagcgcaccagaataagagcgcaccagctaacaatgtgatacggccatatgtcacttaaggatggagatatgttctgagaaatgtgtcattaggcgattttgtcattaaacatcatagcatgtacttccacaaacctagatggtatagcctactacacacctaggctatttggtatagcctgttggtcctggggtacaaatctgtacaacatgttactgtattgaatacagtaggcaattgtaacacaatggtaagtatctaaacatagaaaagggacagtaaaaatatggttttataatcttctgggaccaccattgtatatgcggtacatcattgaccaaaacatcgttatccagcatatgactgtatttggttatgaaagccaactgttacttgattctgcttttagttcttaagaggatcaggcttttaaatactcatttacaagttttctatcctccttcagtgttaaagtagaaagtaaaaagagtatcttatacatgcatgaaattaaagcatataccaaatgc

SEQ ID NO: 18708 - DNA, 2754 bp, Homo sapiens
gcgccctcgccgcggacaccggagctgcggccgctccccgctgtcccccagatggcagatcctgaggtagttgtgagtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagctggtcttatttgggctaagtaaccagatggtggtagctttcaaggaagagaatactatagcattcaaacaccttttcctaaaaggatatatggaccgaatggatgacacatatgcagtgtacacacaaagtgacgtgtatgatcagttaatcttcgcagtaaaccagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactgagtgtttctttgtggagccagatgaaccttttcacattgggacaccagcagaaaataaactgaacttaacactggacttccacagactcctaacagtggagcttcagtttaaactgaaagccattaatctgcagacagttcgtcatcaagaactccctgactgttatgactttactctgactataacatttgacaacaaggcccatagtggaagaattaaaataagtttagataatgacatttccatcagagaatgtaaagactggcatgtatctggatcaattcagaagaacactcattacatgatgatctttgatgcctttgtcattctgacttgcttggtttcattaatcctctgcattagatctgtgattagaggacttcagcttcagcaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaagagtctaactagttatgatgtctgtagcatacttcttgggacttctaccatgctcgtgtggcttggagtcatccgatacctcggtttctttgcaaagtacaacctcctcattttgacccttcaggcagcgctgcccaatgtcatcaggttctgctgctgtgcagctatgatttacttaggttactgcttctgtggatggatcgtgctggggccttaccatgacaagtttcgttctctgaacatggtctctgagtgccttttctctctgataaatggagatgatatgtttgccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgtttatatttttaaaagcaatatttaatgtctttgcaactttatgctgggattgtttttaaaaaaactttaatgaggaaagctattggattattattatttcttgtttattttgccatggctttagaatgtattctgtatgcctctcttttgctctgatactgttgctcctgctattctgattgtgcagactgtgtaattagtggaaaacaatccttggtctgactgtgactttggacaactcagtaaccctggcttggaccactctcaggagtccatccttgagagagtgggtgtagttatcatttatacagtaatcattgcattttaaaatcttctcttgaaaggaagaataagagtgcaccagaataagagcgcaccagaataagagcgcaccagctaacaatgtgatacggccatatgtcacttaaggatggagatatgttctgagaaatgtgtcattaggcgattttgtcattaaacatcatagcatgtacttccacaaacctagatggtatagcctactacacacctaggctatttggtatagcctgttggtcctggggtacaaatctgtacaacatgttactgtattgaatacagtaggcaattgtaacacaatggtaagtatctaaacatagaaaagggacagtaaaaatatggttttataatcttctgggaccaccattgtatatgcggtacatcattgaccaaaacatcgttatccagcatatgactgtatttggttatgaaagccaactgttacttgattctgcttttagttcttaagaggatcaggcttttaaatactcatttacaagttttctatcctccttcagtgttaaagtagaaagtaaaaagagtatcttatacatgcatgaaattaaagcatataccaaatgca

SEQ ID NO: 18709 - DNA, 2819 bp, Homo sapiens
ccggggccgaggcccgtgacggggcgggcgggagccccggcagtccggggtcgccggcgagggccatgtcgctgttgggggacccgctacaggccctgccgccctcggccgcccccacggggccgctgctcgcccctccggccggcgcgaccctcaaccgcctgcgggagccgctgctgcggaggctcagcgagctcctggatcaggcgcccgagggccggggctggaggagactggcggagctggcggggagtcgcgggcgcctccgcctcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggaataaagattactgtaaacccagagtcaaaggcagtcttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtgccttatgtggatttggaacaccaaggaacctactggtgtcatgtatataatgatcgagacagtcaagatagcaagaaggtagaaatcatcatagatgaattaaataatcttggtcatcctgataataaagagcaaacaactgaccagcctttggcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatgggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaagaaatgactacgatgataccattccaatcttggatgcactaaaagtcaccgccaatattgtgtttggatatgccacgtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcat

SEQ ID NO: 18710 - DNA, 8789 bp, Homo sapiens
cgaggctccgtgccccgccccccgggtgccccgcccctttgcgcggctggcgcggccagcaggccaggctcccctcggcaaacctgtctaattggggcggggagcggagcttcctcctctgagggccgtgccgcgctgccagatttgttcttccgcccctgcctccgcggctcggaggcgagcggaaggtgccccggggccgaggcccgtgacggggcgggcgggagccccggcagtccggggtcgccggcgagggccatgtcgctgttgggggacccgctacaggccctgccgccctcggccgcccccacggggccgctgctcgcccctccggccggcgcgaccctcaaccgcctgcgggagccgctgctgcggaggctcagcgagctcctggatcaggcgcccgagggccggggctggaggagactggcggagctggcggggagtcgcgggcgcctccgcctcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggaataaagattactgtaaacccagagtcaaaggcagtcttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtgccttatgtggatttggaacaccaaggaacctactggtgtcatgtatataatgatcgagacagtcaagatagcaagaaggtagaaatcatcataggaagaacagatgaggcagtggagtgcactgaagatgaattaaataatcttggtcatcctgataataaagagcaaacaactgaccagcctttggcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatgggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaagaaatgactacgatgataccattccaatcttggatgcactaaaagtcaccgccaatattgtgtttggatatgccacgtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaagttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgttatagaacaggctgaaatttcttgttcataagattatgaaaccacatgagaagtgataaaatgtttgttaaagctagatagaggttaagaatcaagatataatggataattttcatagctgcctatcagaatttcccaaatatttagcatcttccttgataatatgtattttcttcttgaatttcactggcctaatgagataatactcttatctttggctctacctaaaagttggttaaaaatgcaattggcattaacaaggaaaaatactgaattagtaattttaaaagtctcacaaagaaaatcccaggcctagatggctgcattgttgaattctgccaaacattaaaattagcactaattttttgcacactgtttctaaaagtaggagaggaaagaacacttcccaacttactctaggtcagtattaccctgatactagactagacatcacaagaaaactataagccaatattccttattaatacaaacacaaaaatcattaacaaaaatattagcaaactgaatccagcaacctataaaaaggattctatatcatgaccaagtggaatttatcccaggaattcaaggttggttcaacatctaaaaatcaaataagctaatatacagtcagttctcattattcacagtaattatgttctacagaatattctcccataaacactgaattaaatatggaacaactgcttttaggagaaagtgtatttgtgtatatgtgtgtatacatatgtttatctcacacacattatgagcttgaattcttaattcatcctagcaaattctaccttattttacagaagtgaaagtgaggtatcagaagtgttaagtgacatgcctgaggcacccccctaacaggtgtcagagctgaaattcaaaccccatccagctggccccggagccagagcttcttgtactacacagaattgcccctgccatttccaccctccagtcatttctctatgagactgaagcaggaaggcagagcatcatcttgttcagcctcagctgggaacatgtgtactgggtgactcaaatttttcacccatttacacatatccacaaatgactgcaaaagtgccacggatatcaatttgagggttataaattttagcaagttggtaaattcacaaatacataaccttgaataatgaggatcaactgtaccatatttaataaagcacaaaacccacacagattgtcttattacagcatttgataaaatccaaaactctttcataaaaacactcaacaaacttaggaataaaaggaatcttcctagatatgataaatataacatctatgaaaagcccacacctaacattatacttcatggtgatagactgaaggctgaatgttttccccttaagattgggaagaaggacaaggatgttcactcggcactacttctattcagcattgtacttgaagttctagccacagcagttaggttaggaattcaaggtttgttcaacatctaaaaatcaaataagctaataaagaaaagaggtttatactgcaaaagaagtgaaactatatgtattcacagttgatacatagttgtatatagaaaatgctaaagaatccataaaaagtaataaatgagttcaacaggttgcaggatacaagatcagttttatttctctactaacagcaaacattctgaaaatgagaataaagaaatcctatatacagtagcatcaagaataaaactccaacacgtttaaagaaattaagatccagataaatggaaagacatccatgttcatggattggaagactgaatattggtaagatggcaatgctgcccaaattagtctacatattcaacaattcctatcaaaatcctagctgtattttttgcagaaattgacaaactggtaaaattggtagggaaacgcaggggacccagaatagccaaaaaaccttggaaaagaacaaagttggaagacgtaccaatttcaaaaagtgctaccaagctacaataagacagtgtaggcatatggatagacatatcgatcagaggaatggaactgaacatccagaaataaacccatacatttctggtcaacttgttttcaacaaggatgccaataccatcaatagagaaggagtggtcttttcaacaaacggtgctgggacaactaactggtagctacgtgcacagcaaaaggatccctaccttcctaccacattacaaattctaactcaaaatggatcatagacctcaatataagagtttaaactcttagaagaaaacagaagtaaatctttgtgatgttgggcttaggaatggtttcttagacataataccaaaagcacaagcaacaaaggcaaacagtagataaatgggacttcatcaaaattaactttagcgccttaaaggacaccattaagaaagtgaagttaaccctcagaatgggagaaaaatttttgaaaaatcatgtatctgataaaaaaacaaacaaacatgcaggtgctcagctgtggttaccaccgagcagcactgtccagtgaacttgctgtgatgatgggatgcttggtatccgcactcccagtgtgatagcctttagcctcatggggttgttgagcagttgaaataatagctagtgtgaggaactgaacataaaattttagttttaggatgggtgtggtggctcacgcctataatctcagcactttgggaggccaatgaaggcggatcacttgagcccaggagttcaagaccagcttgaccaagatggcaaaaccctgtctctattaaaaatacaaaaaaattagctgggcatggtggcacacacctgtaatcccagctactagggaggctgaggcaggagaatcgtacttcccctttatactcttctgtatatttgatttttttttttttaagacagagtcctggctctgtcgcccaggctggagtgcagcgacatagtctcagctcactgcagcatccgtggaggctgaaacaggagaatcgcatgaattttttaaaaaatctaaacatgtaattttaaaacgggcttaagaagaatgataacagttttggtcttcttttttatcaaccatgcttttattttacttgaatctcgtgccaattgctttgtaatattaaagtaggatttacacaagtggaatttagaaaagatgataatctatcaaatctgtcaataccaattagaatgtaataaagaaattaggatagtggaggtttgagcaagtaaaggctcacccaaattcaaagccaatacttgatgctgagaggggatattttctggaaggtaatttttaaaaattaaagtcacaattataaattgtatatttcctaataaaagaaatctcaactcatgggacaatttgaatttaaaacactattgttcctcattcagtgatgaacaagtcaaaacgtttcagaaaagaaagcctttaaagaagaatcctggcacagaaaaggtccatttagacattgccttcttcccccatctctaatgcctcttttcaaatctctgacttgcacatgaagtaacagtgaggtgtcctgtgcagcagtcgcaattttttgacttgtcaaattgaagaaattcaattatgtagccagagcttagatcactgacatgtatactggcataagcttttttttgtttgtttttaattttattagaagtgggatctcattttgttgcccatgctggtctcaaacacctgtcttcaagtgatcctcctgcctcagcagcatcagtttaatatctagataaaatctgatgtatgtaattttacttttaagggtttttttccaaacagacgtcctgacaatgttgtttcctattccttgaacattcacctgacgcttatatactgtcattacttttatctgtcaactgatgtcagctactcaatttacacattacttttgtgcatttcatcctgtttctcagtttgacattgtcattcaaattcagagtttgacactgaaaccctgggcatggtggctcacacctgtaatcccagcacttcgggagactgcggtaagcagatcatttgaacccaggagtttgagactagccttggcaacatggtgaaaccccatctctaccaaaaaaaaaaaaaaaaaaaaagcaaaaacaaaaattaactgggcatagttgcacacacctgtagtcccagctactcaggaggctgaagtgggacgatcgcttgagcccagaaggcagaggttacggtgagtagagattgtgccactgcactccagcctggacgacagggcaagacgctgtctcaaaaataaaatattagtaaagaagagtacaatcagaatatgaaaatgtgtaaatgtgcatattctctttttttctaatttggtagcattaaaaatacttaagcatcaaagtttggctttatgaagaaggagtctgagacacctcaggtttcagcccttactaatagcgtggctcaaagagcgttaacttgcctgtgcttctgtttccttatctgtaaaatggggatgatgctgtaacatcaaagagcttataatactttccagagctggcagtactaaataagaccattcctctaaagtgccagcattttgaaaagcatcaacccatcaaccttgtgctttaaatctggcattcttaaagctatacctgtaggcagtatagagtgtttttttttatttgtttttttgttgttgtcttttgagtctcactctgtctcccaggctgtagtgcagtggcacgtcttggttcgccgcaacctccgcctcccaggttcaagcgattctcgtgcctcagccccccgcatagctggcattacaggcacacaccaccacgcccagctaatttttgtagttttagtagtatctactaaaataaacagggtttcaccatgttggccaggctggtctcaaactcctgacctcaagtgatctgcctgcctcggcctcccaaagtgctgggattacaggcgtgagtcaccatgcccggccggcagtgtatatcttctaaagttgcaatttttgttcactccagaatcacttttcaaaaagcatgcagatttaatgccaccagtttgtgttatgtatctatcccgcaaaacagctctaaaggtgatttactaaaagattaacagcatttatctctggtgggataatttttctttgcttgtttacctgtgtcttgcagattttacacagtgaacaatgactgtataattttaaaatacagatatgcacaattgtgtaatgtaaatatgctcagcttcaatacatttaagaacacatttttaacttttcgtaaggagtcttcagtttaaaagtacagtgtcattacagagtgcttattctgttacaaaattagtaaagctgattctgcctctaaa

SEQ ID NO: 18711 - DNA, 4182 bp, Homo sapiens
aatgggcgggcggcagggagcgcgcgtgcgcagggcaggtcggggggggggggggggcggggcgaagccgaggaagagcgttttggggacgggggctggtgaggctcacgttggagggcttcgcgtctgcttcggagaccgtaaggatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaa

SEQ ID NO: 18712 - DNA, 4210 bp, Homo sapiens
acgggggctggtgaggctcacgttggagggcttcgcgtctgcttcggagaccgtaaggctgtcatcagctgtggacgggagccttctgaagggaagcacttgggagcctgcaggacgaatacctacaccagacttggaattgaaaagacctcactggagaaagagacatttgatatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaa

SEQ ID NO: 18713 - DNA, 671 bp, Homo sapiens
gctcttaagactagcacggtgggctggcaggcgcccgctgtcggccgaggactgtctgggcgcgcttcctggaggaggcggtgcgtttcgcgcgctcgctgccggcgagccagcctcttcccttactcaccggtgtccggaaaggtgaacgctgcgctcgggctgcctcgcctgttacctccgccgccgggcatgctcagcgtctgcagctgccggaccagctccggcatgcggtcccagtggccctcggcgcggcagcgctccagctcgctctccaccttcaggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactact

SEQ ID NO: 18714 - DNA, 1113 bp, Homo sapiens
tactcaccggtgtccggaaaggtgaacgctgcgctcgggctgcctcgcctgttacctccgccgccgggcatgctcagcgtctgcagctgccggaccagctccggcatgcggtcccagtggccctcggcgcggcagcgctccagctcgctctccaccttcagatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctc

SEQ ID NO: 18715 - DNA, 648 bp, Homo sapiens
ggatccgccatcctacgtcgcccgtggaactacgttcctgagggcttccggcgttgcctagcaactgccgggcccctagggcgtccagcggcccaactggagtggagccgagtgtcgcccttgggaaagcagatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaa

SEQ ID NO: 18716 - DNA, 3955 bp, Homo sapiens
tagcaactgccgggcccctagggcgtccagcggcccaactggagtggagccgagtgtcgcccttgggaaagcaggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaa

SEQ ID NO: 18717 - DNA, 3975 bp, Homo sapiens
gggggcggggcgaagccgaggaagagcgttttggggacgggggctggtgaggctcacgttggagggcttcgcgtctgcttcggagaccgtaagggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaa

SEQ ID NO: 18718 - DNA, 821 bp, Homo sapiens
ggggcgaagccgaggaagagcgttttggggacgggggctggtgaggctcacgttggagggcttcgcgtctgcttcggagaccgtaaggagatgggggtctgactgtgttgtctaggctgatctcaaactcctggcctcaagtgatcctcctgcctcagcctcccaaagtgctgggattacagatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagt

SEQ ID NO: 18719 - DNA, 588 bp, Homo sapiens
acttccctgattcagcgatgagccaggtcagctcagcagagatcagtaagagatgggggtctgactgtgttgtctaggctgatctcaaactcctggcctcaagtgatcctcctgcctcagcctcccaaagtgctgggattacagatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcag

SEQ ID NO: 18720 - DNA, 565 bp, Homo sapiens
agtaaggtaaatgagagccagaggagagagggtcctgactctcagagagggaggaaaagagaaaaatggaaaaggagaacaacctgtgatcgtatgttcaggtcaaatgagtgtgagaggctacagactgaggtcggatgagagagcaattggtcttggctggaagaatcctgaggtgacatttgaacctgtcctggaaggaagttggagatggacagatggaaccagtaggagcggaggctgtggtacaggaagaggctggcagagcaggaggggagcactgtgacagccaaggcactgggaggcgcactgctcctgatggtccagcactgccctcccaggactgaggctgcgccttgtgagggctgtctcaagatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaaca

SEQ ID NO: 18721 - DNA, 4169 bp, Homo sapiens
gctcttaagactagcacggtgggctggcaggcgcccgctgtcggccgaggactgtctgggcgcgcttcctggaggaggcggtgcgtttcgcgcgctcgctgccggcgagccagcctcttcccttactcaccggtgtccggaaaggtgaacgctgcgctcgggctgcctcgcctgttacctccgccgccgggcatgctcagcgtctgcagctgccggaccagctccggcatgcggtcccagtggccctcggcgcggcagcgctccagctcgctctccaccttcaggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaacctc

SEQ ID NO: 18722 - DNA, 7594 bp, Homo sapiens
tgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctggattatcattgcaaatccattaaagaaggagaagcaagcggatttcagagaggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggtgtccactgtgacagcgtgtgtgctgagggacgctggggccccaactgctccctgccctgctactgtaaaaatggggcttcatgctcccctgatgatggcatctgcgagtgtgcaccaggcttccgaggcaccacttgtcagaggatctgctcccctggtttttatgggcatcgctgcagccagacatgcccacagtgcgttcacagcagcgggccctgccaccacatcaccggcctgtgtgactgcttgcctggcttcacaggcgccctctgcaatgaagtgtgtcccagtggcagatttgggaaaaactgtgcaggaatttgtacctgcaccaacaacggaacctgtaaccccattgacagatcttgtcagtgttaccccggttggattggcagtgactgctctcaaccatgtccacctgcccactggggcccaaactgcatccacacgtgcaactgccataatggagctttctgcagcgcctacgatggggaatgtaaatgcactcctggctggacagggctctactgcactcagagatgtcctctagggttttatggaaaagattgtgcactgatatgccaatgtcaaaacggagctgactgcgaccacatttctgggcagtgtacttgccgcactggattcatgggacggcactgtgagcagaagtgcccttcaggaacatatggctatggctgtcgccagatatgtgattgtctgaacaactccacctgcgaccacatcactgggacctgttactgcagccccggatggaagggagcgagatgtgatcaagctggtgttatcatagttggaaatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggaacccttcctcacagcaatggtggaaacgctaatagccactacttcaccaatcccagttaccacacgctcacccagtgtgccacatcccctcacgtcaacaacagggacaggatgactgtcacgaagtcaaaaaacaatcaactgtttgtgaatcttaaaaatgtgaaccctgggaagagaggccctgtgggggactgcactgggacattgccggctgactggaaacatggcggctacctcaacgagctcggtgcttttggacttgacagaagctatatgggaaaatccttaaaagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcagagatcaataactcaacttcagccaacaggaatgtctatgaagttgaacctacagtgagtgttgtccaaggagtattcagcaataatgggcgtctctcccaggatccatatgacctcccaaagaacagtcacatcccttgtcattatgacctgctgccagtccgagacagttcatcctcccctaagcaagaggacagtggtggtagcagcagcaacagcagcagcagcagtgaatgacaccaaaggaccgcttggtagccactggaaccctttccagaactgctgtttggttcttctccatcctcaattttgccactttcatgtgaatgttagtcaattcggtgggcaatttttggacatgaaccagaaagctgaaagctgaggctgacacggactgtaggtgctttttgttcaggtggattcgaaggagttagagatgtgatttcccattgctgttagttttagaactatacccgtgaagcatgacttattgtaagatgttggctgaaagcatgaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctttttggtgagaagaaataagacattttctcccttttaaagatcatctcttcagagctgcatggtaaatttgaatttccccattgttctctagagctaggtcaaaaaaacaactgtttcttttcttattccactattaataaattgaaagcttgctgtacaaaggcaacagcaacttaaaaaagaaaatctggacaatagatgtggactccaaggggccactgccatcccttcctgtgtgctctttttgacaagtaaatcactccagttagctgatgtcctgaaatgacatttgtacctgaggcaattcttattagagcttactcaggacttttcaaacatcaggacacacatagcaatttggatgttgtaaaactacgtgttacatttggagaggtcttgttgagaaggcaaaattttctaaatattttgatatcaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcagaaaatttataagttatttgtatttatatataagtacatcagaacttgcccacatgataactcatgtttgctttaataaggaaaatatgttatttgaggttaattatatgatagtgaggaacattttacaattatttacagtgtttgacattaattgctgtcctatgatacagtagtaatgttaacagagagtttaatatgtttagcattatctttatggaatttatattcaccaatttcaggaaaaccaaccatagaactttataataggacagttataacctgactgaaccaaatccatcagcataatgactgtgtgttctgagaaatgcaaacaactttatgaaagtgtggtcatcttgacccccaaagagccacagtagctgtcaattattgagatttttaaatggtaaatattgcaaaagttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcacatcatgaaagtgtacatgcatatgcaagtgtgaattacgtggtatggatgtttgcttgtttattaactaaagatgtacagcaaactgcccgtttagagtcctgttaatattgatgtcctaacactgggtctgcttatgctagttcagtatttggtctaggcttcattttgatatgactgaattgcaatctatatttttaaaaagaaaaatcaaaatacattagggtttacttggttgtggcaaacaaacaaaaaatgctttcagtgttgaaatatctctattttccaaagatgataaactttcatcgttcttagcctacattgtcatttatatcaccaaatgagtttatagattaatgcaataaactttctaataaaaaa

SEQ ID NO: 18723 - DNA, 2238 bp, Homo sapiens
aaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctggattatcattgcaaatccattaaagaaggagaagcaagcggatttcagagaggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggattgttttgactattctgggtccttgaatttccatgtgaatggtaacatcaatatgttaatttccacaaagaagcaaggtggaaatttaatggagattgaatctatagatcaatttggggaatactgtccacttaacaatatgaagtcttcagattcataaacatgggatgtcaccagcaacctcttcagtagtgtctctcagccccttggaaaatgttgagagcttctttggtttctaaaggagtaaactgagatgaactgtca

SEQ ID NO: 18724 - DNA, 7571 bp, Homo sapiens
actttcccggtgcgcaaaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctgggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggtgtccactgtgacagcgtgtgtgctgagggacgctggggccccaactgctccctgccctgctactgtaaaaatggggcttcatgctcccctgatgatggcatctgcgagtgtgcaccaggcttccgaggcaccacttgtcagaggatctgctcccctggtttttatgggcatcgctgcagccagacatgcccacagtgcgttcacagcagcgggccctgccaccacatcaccggcctgtgtgactgcttgcctggcttcacaggcgccctctgcaatgaagtgtgtcccagtggcagatttgggaaaaactgtgcaggaatttgtacctgcaccaacaacggaacctgtaaccccattgacagatcttgtcagtgttaccccggttggattggcagtgactgctctcaaccatgtccacctgcccactggggcccaaactgcatccacacgtgcaactgccataatggagctttctgcagcgcctacgatggggaatgtaaatgcactcctggctggacagggctctactgcactcagagatgtcctctagggttttatggaaaagattgtgcactgatatgccaatgtcaaaacggagctgactgcgaccacatttctgggcagtgtacttgccgcactggattcatgggacggcactgtgagcagaagtgcccttcaggaacatatggctatggctgtcgccagatatgtgattgtctgaacaactccacctgcgaccacatcactgggacctgttactgcagccccggatggaagggagcgagatgtgatcaagctggtgttatcatagttggaaatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggaacccttcctcacagcaatggtggaaacgctaatagccactacttcaccaatcccagttaccacacgctcacccagtgtgccacatcccctcacgtcaacaacagggacaggatgactgtcacgaagtcaaaaaacaatcaactgtttgtgaatcttaaaaatgtgaaccctgggaagagaggccctgtgggggactgcactgggacattgccggctgactggaaacatggcggctacctcaacgagctcggtgcttttggacttgacagaagctatatgggaaaatccttaaaagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcagagatcaataactcaacttcagccaacaggaatgtctatgaagttgaacctacagtgagtgttgtccaaggagtattcagcaataatgggcgtctctcccaggatccatatgacctcccaaagaacagtcacatcccttgtcattatgacctgctgccagtccgagacagttcatcctcccctaagcaagaggacagtggtggtagcagcagcaacagcagcagcagcagtgaatgacaccaaaggaccgcttggtagccactggaaccctttccagaactgctgtttggttcttctccatcctcaattttgccactttcatgtgaatgttagtcaattcggtgggcaatttttggacatgaaccagaaagctgaaagctgaggctgacacggactgtaggtgctttttgttcaggtggattcgaaggagttagagatgtgatttcccattgctgttagttttagaactatacccgtgaagcatgacttattgtaagatgttggctgaaagcatgaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctttttggtgagaagaaataagacattttctcccttttaaagatcatctcttcagagctgcatggtaaatttgaatttccccattgttctctagagctaggtcaaaaaaacaactgtttcttttcttattccactattaataaattgaaagcttgctgtacaaaggcaacagcaacttaaaaaagaaaatctggacaatagatgtggactccaaggggccactgccatcccttcctgtgtgctctttttgacaagtaaatcactccagttagctgatgtcctgaaatgacatttgtacctgaggcaattcttattagagcttactcaggacttttcaaacatcaggacacacatagcaatttggatgttgtaaaactacgtgttacatttggagaggtcttgttgagaaggcaaaattttctaaatattttgatatcaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcagaaaatttataagttatttgtatttatatataagtacatcagaacttgcccacatgataactcatgtttgctttaataaggaaaatatgttatttgaggttaattatatgatagtgaggaacattttacaattatttacagtgtttgacattaattgctgtcctatgatacagtagtaatgttaacagagagtttaatatgtttagcattatctttatggaatttatattcaccaatttcaggaaaaccaaccatagaactttataataggacagttataacctgactgaaccaaatccatcagcataatgactgtgtgttctgagaaatgcaaacaactttatgaaagtgtggtcatcttgacccccaaagagccacagtagctgtcaattattgagatttttaaatggtaaatattgcaaaagttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcacatcatgaaagtgtacatgcatatgcaagtgtgaattacgtggtatggatgtttgcttgtttattaactaaagatgtacagcaaactgcccgtttagagtcctgttaatattgatgtcctaacactgggtctgcttatgctagttcagtatttggtctaggcttcattttgatatgactgaattgcaatctatatttttaaaaagaaaaatcaaaatacattagggtttacttggttgtggcaaacaaacaaaaaatgctttcagtgttgaaatatctctattttccaaagatgataaactttcatcgttcttagcctacattgtcatttatatcaccaaatgagtttatagattaatgcaataaactttctaataaaaaa

SEQ ID NO: 18725 - DNA, 5707 bp, Homo sapiens
gcccgctgcccgccgcccggctcccggctgctcgcggccccctgctcctgcctggcgctctggccaggctcgggctccggaggacaggaccgcgcgactggccggccgatccctgggccggccgcgggagcagctatgctgtgactgtccaggaatcgtatgcacaccccttcgatcagatctattacacacgatgcacagacatcctcaactggttcaagtgcaccaggcaccgccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacgtgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctcccttttttcctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaactaattt

SEQ ID NO: 18726 - DNA, 6144 bp, Homo sapiens
gcccgctgcccgccgcccggctcccggctgctcgcggccccctgctcctgcctggcgctctggccaggctcgggctccggaggacaggaccgcgcgactggccggccgatccctgggccggccgcgggagcagggcccgggatggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgtaagccccacctcctggcctcccagccacttagaataccatgctgcggcctactggccactgtgggcattgtccagaccagcagggagggaggaatgcaggcagccccaggactggtggtacctgactcctgccccacgagaactgaggagctctgcaggggcagctccagacctgactggattcaggggattgacaagcccaaagtcctggaaggtcagggctgcaaggctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacgtgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctcccttttttcctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaactaattt

SEQ ID NO: 18727 - DNA, 2956 bp, Homo sapiens
aggacaggaccgcgcgactggccggccgatccctgggccggccgcgggagcagggcccgggatggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcagcatcaaccacaccatggtggcctgtcatggaacacctagctcgccctttctctcaacggcctaggacccagctcagtaacaagtcccttgacagagacacagcaggctggaccccctacagctatgtgaacgtgttagatcagtgccctggaggccaggtacccgcccgaggacttctacattga

SEQ ID NO: 18728 - DNA, 5813 bp, Homo sapiens
gcccgctgcccgccgcccggctcccggctgctcgcggccccctgctcctgcctggcgctctggccaggctcgggctccggaggacaggaccgcgcgactggccggccgatccctgggccggccgcgggagcagggcccgggatggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccgccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacgtgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctcccttttttcctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaactaattt

SEQ ID NO: 18729 - DNA, 5946 bp, Homo sapiens
cgctcccggtgcccgctgcccgccgcccggctcccggctgctcgcggccccctgctcctgcctggcgctctggccaggctcgggctccggaggacaggaccgcgcgactggccggccgatccctgggccggccgcgggagcagcctcctttgttctcctgtgcagggcccgggatggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacgtgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctcccttttttcctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaactaattt

SEQ ID NO: 18730 - DNA, 5914 bp, Homo sapiens
gcccgctgcccgccgcccggctcccggctgctcgcggccccctgctcctgcctggcgctctggccaggctcgggctccggaggacaggaccgcgcgactggccggccgatccctgggccggccgcgggagcagggcccgggatggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacgtgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctcccttttttcctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaactaattt

SEQ ID NO: 18731 - DNA, 4501 bp, Homo sapiens
gagaacttaaaggcgaggggcggggcgcgcccggcccagagcggctcccgggcggcgccgagcggagcggatcccggggctgggattgcgcgcccgcccggaacccagaaccagcccgagccgcctgccccgtcgcccggccgccggcttagggcgcagcgcggttggtcctcgccccctcccgcccgccggcctaccaggccatgggggcgtcccgggaccgcgggctggccgcgctctggtgccttgggctcctggggggcctggcgcgcgtcgcgggcacgcactaccgctacctctggaggggctgctacccatgtcacctgggccaggccggctaccccgtgagcgccggtgaccagaggccagatgtggacgaatgccgaacccacaacggtggctgccagcaccggtgcgtgaacaccccaggctcctacctctgtgagtgcaagcccggcttccggctccacactgacagcaggacctgcctggccattaactcctgcgccctgggcaatggcggctgccagcaccactgtgtccagctcacaatcactcggcatcgctgccagtgccggcccgggttccagctccaggaggacggcaggcattgtgtccgtagaagcccgtgtgccaacaggaacggcagctgcatgcacaggtgccaggtggtccggggcctcgcccgctgtgagtgccacgtgggctatcagctagcagcggacggcaaggcctgtgaagatgtggacgaatgtgccgcagggctggcccagtgtgcccatggctgcctcaacacccaggggtccttcaagtgcgtgtgtcacgcgggctatgagctgggcgccgatggccggcagtgctaccggattgagatggaaatcgtgaacagctgtgaggccaacaacggcggctgctcccatggctgcagccacaccagtgctgggcccctgtgcacatgtccccgcggctacgagctggacacagatcagaggacctgcatcgatgtcgacgactgtgcagacagcccgtgctgccagcaggtgtgcaccaacaaccctggcgggtacgagtgcggctgctacgccggctaccggctcagtgccgatggctgcggctgtgaggatgtggatgagtgcgcctccagccgtggcggctgcgagcaccactgcaccaacctggccggctccttccagtgctcctgcgaggccggctaccggctgcacgaggaccgtaggggctgcagccccctggaggagccgatggtggacctggacggcgagctgcctttcgtgcggcccctgccccacattgccgtgctccaggacgagctgccgcaactcttccaggatgacgacgtcggggccgatgaggaagaggcagagttgcggggcgaacacacgctcacagagaagtttgtctgcctggatgactcctttggccatgactgcagcttgacctgtgatgactgcaggaacggagggacctgcctcctgggcctggatggctgtgattgccccgagggctggactgggctcatctgcaatgagacttgtcctccggacacctttgggaagaactgcagcttctcctgcagctgtcagaatggtgggacctgcgactctgtcacgggggcctgccgctgccccccgggtgtcagtggaactaactgtgaggatggctgccccaagggctactatggcaagcactgtcgcaagaaatgcaactgtgccaaccggggccggtgccaccgcctctacggggcctgcctctgcgacccagggctctacggccgcttctgccacctcacctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccgccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagaagtgcctcccccgggacgtcagagctggctgccggcacagcggcggttgcctcaacgggggcctgtgtgacccgcacacgggccgctgcctctgcccagccggctggactggggacaagtgtcagagcccctgcctgcggggctggtttggagaggcctgtgcccagcgctgcagctgcccgcctggcgctgcctgccaccacgtcactggggcctgccgctgtccccctggcttcactggctccggctgcgagcagggatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcaccggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctttttggtgctaggccctgggactggaagtcgcccagcccgtatttatgtaaaggtatttatgggccactgcacatgcccgctgcagccctgggatcagctggaagctgcctgtcatctcctgcccaatccccagaaaccctgattcaggtctgcaggctcctgcgggctcaccaggctgctggctccggtaccatgtaaacctaggaaggtaaaggagcaggcaacctc

SEQ ID NO: 18732 - DNA, 5455 bp, Homo sapiens
cgccggggcgagttcctgcagggtggacccggcgatcaggtctccgcggtgccactttgggcgcgggcgggaagccgggacgctccgcacctgcagcgaccttgggctccgcggagcgggcgcgggcacctgtggctgcgtcctatggcgcacgtggaggcggaggctccggggagccgccggggccgcctgtgagccggagagcggaggaggcaccggcgcgcacgatgtcgttccttgaagaggcgagggcagcggggcgcgcggtggtcctggcgttggtgctgctgctgctccccgccgtgcccgtgggcgccagcgttccgccgcggcccctgctcccgctgcagcccggcatgccccacgtgtgtgctgagcaggagctgaccctggtgggccgccgccagccgtgcgtgcaggccttaagccacacggtgccggtgtggaaggccggctgtgggtggcaggcgtggtgcgtgggtcatgagcggagaaccgtctactacatgggctacaggcaggtgtataccacggaggcccggaccgtgctcaggtgctgccgagggtggatgcagcagcccgacgaggagggctgcctctcggctgaatgcagcgccagcctctgttttcacggtggccgttgtgtgccaggctcagcccagccgtgtcactgtccccccggcttccagggaccccgctgtcagtatgatgtggacgaatgccgaacccacaacggtggctgccagcaccggtgcgtgaacaccccaggctcctacctctgtgagtgcaagcccggcttccggctccacactgacagcaggacctgcctggccattaactcctgcgccctgggcaatggcggctgccagcaccactgtgtccagctcacaatcactcggcatcgctgccagtgccggcccgggttccagctccaggaggacggcaggcattgtgtccgtagaagcccgtgtgccaacaggaacggcagctgcatgcacaggtgccaggtggtccggggcctcgcccgctgtgagtgccacgtgggctatcagctagcagcggacggcaaggcctgtgaagatgtggacgaatgtgccgcagggctggcccagtgtgcccatggctgcctcaacacccaggggtccttcaagtgcgtgtgtcacgcgggctatgagctgggcgccgatggccggcagtgctaccggattgagatggaaatcgtgaacagctgtgaggccaacaacggcggctgctcccatggctgcagccacaccagtgctgggcccctgtgcacatgtccccgcggctacgagctggacacagatcagaggacctgcatcgatgtcgacgactgtgcagacagcccgtgctgccagcaggtgtgcaccaacaaccctggcgggtacgagtgcggctgctacgccggctaccggctcagtgccgatggctgcggctgtgaggatgtggatgagtgcgcctccagccgtggcggctgcgagcaccactgcaccaacctggccggctccttccagtgctcctgcgaggccggctaccggctgcacgaggaccgtaggggctgcagccccctggaggagccgatggtggacctggacggcgagctgcctttcgtgcggcccctgccccacattgccgtgctccaggacgagctgccgcaactcttccaggatgacgacgtcggggccgatgaggaagaggcagagttgcggggcgaacacacgctcacagagaagtttgtctgcctggatgactcctttggccatgactgcagcttgacctgtgatgactgcaggaacggagggacctgcctcctgggcctggatggctgtgattgccccgagggctggactgggctcatctgcaatgagacttgtcctccggacacctttgggaagaactgcagcttctcctgcagctgtcagaatggtgggacctgcgactctgtcacgggggcctgccgctgccccccgggtgtcagtggaactaactgtgaggatggctgccccaagggctactatggcaagcactgtcgcaagaaatgcaactgtgccaaccggggccggtgccaccgcctctacggggcctgcctctgcgacccagggctctacggccgcttctgccacctcacctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccgccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagacctgcccagcccacacctacgggcacaattgcagccaggcctgtgcctgctttaacggggcctcctgtgaccctgtccacgggcagtgccactgtgcccctggctggatggggccctcctgcctgcaggcctgccctgccggcctgtacggcgacaactgtcggcattcctgcctctgccagaacggagggacctgtgaccctgtctcaggccactgtgcgtgcccagagggctgggccggcctggcctgtgagaaggagtgcctcccccgggacgtcagagctggctgccggcacagcggcggttgcctcaacgggggcctgtgtgacccgcacacgggccgctgcctctgcccagccggctggactggggacaagtgtcagagcccctgcctgcggggctggtttggagaggcctgtgcccagcgctgcagctgcccgcctggcgctgcctgccaccacgtcactggggcctgccgctgtccccctggcttcactggctccggctgcgagcaggcctgcccacccggcagctttggggaggactgtgcgcagatgtgccagtgtcccggtgagaacccggcctgccaccctgccaccgggacctgctcatgtgctgctggctaccacggccccagctgccagcaacgatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctttttggtgctaggccctgggactggaagtcgcccagcccgtatttatgtaaaggtatttatgggccactgcacatgcccgctgcagccctgggatcagctggaagctgcctgtcatctcctgcccaatccccagaaaccctgattcaggtctgcaggctcctgcgggctcaccaggctgctggctccggtaccatgtaaacctaggaaggtaaaggagcaggc

SEQ ID NO: 18733 - DNA, 10184 bp, Homo sapiens
ggccgctctggcccaagcgtcccctcgtctctctgatctggcccatccggcttcggagggaggcgagggtgggtgagcaaagggattgggtctgtggggtccaggcccgaacccctgaagacgggctccgcccccggcacccgctcgcgccccgcccccggctggaggagtctctcctggaccatccgaacctagcctgtcccggcccgcagcctctatggaggctcctgccgggccgtagagcccttcgccccctggggacccacccgtctataaggtccgtttggcctgcagcagcctgagtccgtaatgctgggcactgttcatgggatcggccccctatggagccctgtgtctataggggactcctacggtccctagggttcggccccgtccataatgactccatatacagggccttccatcgctctatagggctcagccctcggcttccagagcctgtcagcagtggccgtacccttcgccgggactgccgggtctccgggacctcttcgatctacaaggtcatgttatgcctatagaggtcgcatttgcagggcctcaccccgggtagagggtcctctccaggtttttacggcctgtccccgctctaagggtcagtgcaggaggcggcgatggccctgggcaaggttctggccatggcactggttttggccttggccgtgctggggtcgctgtcccctggggcccgggcgggggactgcaaggggcagcggcaggtgctgcgggaggcgccaggcttcgtgacggatggtgcgggcaactacagcgtcaatggcaactgcgagtggctcatcgaggccccaagcccccagcaccggatcctgctggacttccttttcctggacacagagtgcacgtatgactacctgttcgtgtatgacggtgactccccgcgagggccgctgcttgccagtctaagtgggagcacccgacctccgcccatcgaagcttcctcaggcaagatgctgctgcacctcttcagtgatgccaactacaacctgctgggctttaacgcctcattccgcttctccctgtgcccgggtggctgccagagccacgggcagtgccagccaccgggtgtgtgtgcctgcgagccgggctgggggggtcctgactgtggcctgcaggagtgctcagcctactgtggcagccacggcacctgcgcctcgcccctgggaccatgccgctgtgagcctggcttcttgggacgtgcctgtgacctgcacctgtgggagaaccagggggctgggtggtggcacaacgtgagtgccagggaccctgccttctctgcccgtattggggcagctggcgccttcctgtccccaccagggctgctggcagttttcggaggccaggacctcaacaatgccctgggtgacctcgtcctatacaacttctccgccaacacctgggagtcttgggacctgagtcctgccccggctgcccgtcactcccatgtggccgtggcctgggccggctccctggtactgatgggtggtgagctggctgacggctcgctcaccaacgacgtgtgggccttcagtccactgggcaggggccactgggagctcctggcaccacctgcctccagctcctcggggcccccaggcctggcaggtcacgcggctgccctggtggatgatgtctggctatatgtgtctggaggccgcaccccgcacgacctcttctcctctggcctcttccgtttccgccttgacagcaccagcgggggctattgggagcaggtgattccggcaggcggacggccccctgctgccactggccactccatggtgttccatgccccctcccgtgccctgctggtccatggtggacaccggccctccactgcccggttctctgtgcgagtgaactccactgagcttttccacgtggatcggcatgtgtggacgacgctgaaggggcgggatgggcttcagggcccaagggagcgagccttccacacagccagtgttctgggcaattacatggtggtctatgggggcaatgtgcacacccattaccaggaggaaaagtgctacgaagatggcatcttcttctaccaccttggctgccatcaatgggtgtcaggagctgagcttgccccgccaggaacccctgagggccgagcagcgcctcccagtggtcggtactcacatgtagctgcggtgcttggtggcagcgtcctgttggtggctggggggtacagcggccggccccgtggggacttgatggcgtacaaggtgcccccctttgtgttccaggcacctgcccctgactaccacttggactactgctccatgtacacagaccacagcgtctgctcccgggacccggaatgcagttggtgccaaggagcctgccaagctgcaccccctcctgggacccccttgggggcttgtccagccgccagctgcctgggcctgggccgcctcctgggtgactgccaggcctgcctggccttcagcagccccacagcccctccacggggacctggcaccctgggctggtgcgtgcacaatgagagctgcctccctaggcctgagcaggcccgctgccgaggggagcagatctcaggcactgtgggctggtgggggcctgcgcctgtcttcgtcacgtccctggaggcctgcgtcacccagagcttcctgcctggcctgcacttgctcacctttcagcagccgcccaatacctcccagcctgacaaggtctcaattgtccgcagcacgaccatcaccctaacacccagcgcagagacagatgtgtccctggtctaccgtggcttcatctacccaatgctgcctggagggccaggtggaccaggggctgaggacgtggccgtgtggacgcgggcccagcgcctacacgtcctggcccggatggcccgtggccctgacacggagaacatggaggaggtggggcgctgggtggctcatcaggagaaggagacgcggcggctgcagcgccctgggtctgctcgcctcttccctctgcctgggcgggaccacaagtatgcagtagagatccagggccagctcaatggctcggcaggccctgggcacagcgagctaactctgctgtgggatcggactggtgtgccaggaggcagcgagatctccttcttcttcctggagccctaccgctcgtcgtcctgcacctcctattcttcctgcctgggctgcttggcagaccagggctgtggctggtgcctgaccagtgccacctgccacctgcgccagggcggagcccattgcggggatgacggggctggtgggtccctgctggtgctggtgcctaccctctgcccactctgcgaggagcatcgggactgccacgcctgcacccaggaccccttctgtgagtggcatcagagcaccagccgcaaaggggacgcggcatgcagccggcggggccggggtcggggtgccctgaagagtccagaggagtgtcccccgctctgcagccagcgactgacctgtgaggactgcctggccaactctagccagtgcgcctggtgccagtccacccacacctgcttcctgtttgctgcctacttggcccggtacccacacgggggctgtcgaggctgggacgacagtgtacactcggagccacggtgccggagctgcgatggcttcctgacctgccatgagtgtctgcagagccacgagtgtggctggtgtggcaatgaggacaaccccacactgggacggtgcctacagggggacttctcagggcccctcggtgggggtaactgctccctgtgggtgggggagggcctggggcttcccgtggccctccctgcccgctgggcatacgcccgctgtcctgacgtggatgagtgtcgcctgggcctggcccggtgccacccgcgggcgacctgcctgaacacgcccctcagctacgagtgtcactgccagcggggctaccagggtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacaggtctctatggtcactctgctgtctaccacgaggccaccgactccctctacgtgtttggggggttccgattccatgtggagctggcggccccatcccccgagctctactccctgcactgtcctgaccgcacctggagtctgctggccccttctcagggggcaaagcgagatcgtatgaggaatgtgcgtggctcatctcggggtctgggccaagttcctggggagcagcctgggtcatgggggttccgggaagtcaggaagaagatggctctgtgggctgctcttgctggtacaggaggtttcctggaggaaatctcacctcacctgaaggagccccgcccccggcttttccacgcctcagccctgttaggggacaccatggtggttcttggggggcgctcggaccctgacgagttcagcagcgacgttctgctctaccaggtcaactgcaatgcctggcttctgcccgacctcacccgctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggcgtccaccccccgctgtaagtggtgtaccaactgccccgaaggtgcttgcattggacgcaatgggtcctgcacctctgagaatgactgtcggatcaaccagcgagaggtcttctgggcagggaactgctccgaggctgcgtgcggggctgctgactgcgagcagtgcacgcgggagggcaagtgcatgtggacgcggcagttcaagaggacaggggagacccgccgcatcctctccgtgcagcccacctatgactggacgtgcttcagccactctctgctgaatgtgtcccccatgccggtggaatcatcacccccactgccctgccccaccccttgtcacctcctacccaactgtacctcctgcctggactctaagggagcagatgggggctggcagcactgtgtttggagcagcagcctgcagcagtgtctgagcccttcctacctgcccctgcgatgtatggccggaggctgtgggcggctgctccggggacctgagagctgctccctgggctgtgctcaggcaactcagtgcgccttgtgcctgcggcgcccccattgcggctggtgtgcctgggggggccaggatgggggtggccgctgcatggagggtggactcagcggcccccgtgatgggctgacatgtgggcgtccgggggcctcctgggccttcctgtcctgcccccctgaggacgagtgtgcaaacgggcaccacgactgcaacgagacgcagaattgccacgaccagccccacggctatgagtgcagctgcaagaccggctataccatggacaacatgacagggctgtgccgccctgtgtgcgcccagggctgcgtgaacggctcatgtgtggagcccgaccactgccgctgccactttggctttgtgggccgcaactgctccacggaatgccgctgcaaccgccacagtgaatgcgctggtgttggggcgcgtgaccactgcttgctctgccgcaaccacaccaagggcagccactgtgagcagtgcctcccgctgtttgtgggttcagctgtcggaggcgggacctgccggccctgccacgccttttgtcgtggaaatagccacatctgcatctccaggaaggagttacaaatgtccaagggagagccaaagaagtactcactggacccagaggagattgaaaactgggtgacagagggtcctagtgaagacgaggccgtgtgcgtgaactgccagaataacagctatggggagaaatgcgagagctgcctgcagggctacttcctcctggacgggaagtgcaccaaatgccagtgtaatggccacgcggacacatgtaacgagcaggatgggacgggctgtccatgtcagaataacacagagacgggcacatgccagggcagctcccccagtgaccgtcgagactgctacaagtaccagtgcgccaagtgccgggaatcatttcacgggagtccgctgggcggccagcagtgctaccgcctcatctcggtggagcaggagtgctgcctggaccccacgtcccagaccaactgcttccatgagcccaaacgccgggcgctaggccccggccgcactgtcctctttggcgtgcagcccaaattcaccaacgtggacatccgcctgacgctggacgtgaccttcggggccgtggacctctatgtctccacctcctatgacaccttcgtggtccgtgtggcccctgacactggcgtccatactgtacacatccagccacccccagccccaccacctccaccaccccctgcagatggtgggccccggggggctggggatccaggaggagcaggggccagcagtgggccgggcgccccagcagagccacgggtacgggaggtatggccgcggggcctgattacctacgtgacggtgacggagccgtcggcagtgctggtggtccgcggcgtgcgggaccggctggtcatcacctacccacacgagcaccatgccctcaagtcgagccgcttctacctgctgctgctgggcgtgggagacccaagtgggcccggcgccaacggctcagccgactcgcagggcctgctcttcttccggcaggaccaggcccacattgacctgtttgtcttcttctccgtcttcttctcctgcttcttcctcttcctctcactctgtgtgctcctctggaaggccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctc

SEQ ID NO: 18734 - DNA, 10966 bp, Homo sapiens
ggccgctctggcccaagcgtcccctcgtctctctgatctggcccatccggcttcggagggaggcgagggtgggtgagcaaagggattgggtctgtggggtccaggcccgaacccctgaagacgggctccgcccccggcacccgctcgcgccccgcccccggctggaggagtctctcctggaccatccgaacctagcctgtcccggcccgcagcctctatggaggctcctgccgggccgtagagcccttcgccccctggggacccacccgtctataaggtccgtttggcctgcagcagcctgagtccgtaatgctgggcactgttcatgggatcggccccctatggagccctgtgtctataggggactcctacggtccctagggttcggccccgtccataatgactccatatacagggccttccatcgctctatagggctcagccctcggcttccagagcctgtcagcagtggccgtacccttcgccgggactgccgggtctccgggacctcttcgatctacaaggtcatgttatgcctatagaggtcgcatttgcagggcctcaccccgggtagagggtcctctccaggtttttacggcctgtccccgctctaagggtcagtgcaggaggcggcgatggccctgggcaaggttctggccatggcactggttttggccttggccgtgctggggtcgctgtcccctggggcccgggcgggggactgcaaggggcagcggcaggtgctgcgggaggcgccaggcttcgtgacggatggtgcgggcaactacagcgtcaatggcaactgcgagtggctcatcgaggccccaagcccccagcaccggatcctgctggacttccttttcctggacacagagtgcacgtatgactacctgttcgtgtatgacggtgactccccgcgagggccgctgcttgccagtctaagtgggagcacccgacctccgcccatcgaagcttcctcaggcaagatgctgctgcacctcttcagtgatgccaactacaacctgctgggctttaacgcctcattccgcttctccctgtgcccgggtggctgccagagccacgggcagtgccagccaccgggtgtgtgtgcctgcgagccgggctgggggggtcctgactgtggcctgcaggagtgctcagcctactgtggcagccacggcacctgcgcctcgcccctgggaccatgccgctgtgagcctggcttcttgggacgtgcctgtgacctgcacctgtgggagaaccagggggctgggtggtggcacaacgtgagtgccagggaccctgccttctctgcccgtattggggcagctggcgccttcctgtccccaccagggctgctggcagttttcggaggccaggacctcaacaatgccctgggtgacctcgtcctatacaacttctccgccaacacctgggagtcttgggacctgagtcctgccccggctgcccgtcactcccatgtggccgtggcctgggccggctccctggtactgatgggtggtgagctggctgacggctcgctcaccaacgacgtgtgggccttcagtccactgggcaggggccactgggagctcctggcaccacctgcctccagctcctcggggcccccaggcctggcaggtcacgcggctgccctggtggatgatgtctggctatatgtgtctggaggccgcaccccgcacgacctcttctcctctggcctcttccgtttccgccttgacagcaccagcgggggctattgggagcaggtgattccggcaggcggacggccccctgctgccactggccactccatggtgttccatgccccctcccgtgccctgctggtccatggtggacaccggccctccactgcccggttctctgtgcgagtgaactccactgagcttttccacgtggatcggcatgtgtggacgacgctgaaggggcgggatgggcttcagggcccaagggagcgagccttccacacagccagtgttctgggcaattacatggtggtctatgggggcaatgtgcacacccattaccaggaggaaaagtgctacgaagatggcatcttcttctaccaccttggctgccatcaatgggtgtcaggagctgagcttgccccgccaggaacccctgagggccgagcagcgcctcccagtggtcggtactcacatgtagctgcggtgcttggtggcagcgtcctgttggtggctggggggtacagcggccggccccgtggggacttgatggcgtacaaggtgcccccctttgtgttccaggcacctgcccctgactaccacttggactactgctccatgtacacagaccacagcgtctgctcccgggacccggaatgcagttggtgccaaggagcctgccaagctgcaccccctcctgggacccccttgggggcttgtccagccgccagctgcctgggcctgggccgcctcctgggtgactgccaggcctgcctggccttcagcagccccacagcccctccacggggacctggcaccctgggctggtgcgtgcacaatgagagctgcctccctaggcctgagcaggcccgctgccgaggggagcagatctcaggcactgtgggctggtgggggcctgcgcctgtcttcgtcacgtccctggaggcctgcgtcacccagagcttcctgcctggcctgcacttgctcacctttcagcagccgcccaatacctcccagcctgacaaggaggaggtggggcgctgggtggctcatcaggagaaggagacgcggcggctgcagcgccctgggtctgctcgcctcttccctctgcctgggcgggaccacaagtatgcagtagagatccagggccagctcaatggctcggcaggccctgggcacagcgagctaactctgctgtgggatcggactggtgtgccaggaggcagcgagatctccttcttcttcctggagccctaccgctcgtcgtcctgcacctcctattcttcctgcctgggctgcttggcagaccagggctgtggctggtgcctgaccagtgccacctgccacctgcgccagggcggagcccattgcggggatgacggggctggtgggtccctgctggtgctggtgcctaccctctgcccactctgcgaggagcatcgggactgccacgcctgcacccaggaccccttctgtgagtggcatcagagcaccagccgcaaaggggacgcggcatgcagccggcggggccggggtcggggtgccctgaagagtccagaggagtgtcccccgctctgcagccagcgactgacctgtgaggactgcctggccaactctagccagtgcgcctggtgccagtccacccacacctgcttcctgtttgctgcctacttggcccggtacccacacgggggctgtcgaggctgggacgacagtgtacactcggagccacggtgccggagctgcgatggcttcctgacctgccatgagtgtctgcagagccacgagtgtggctggtgtggcaatgaggacaaccccacactgggacggtgcctacagggggacttctcagggcccctcggtgggggtaactgctccctgtgggtgggggagggcctggggcttcccgtggccctccctgcccgctgggcatacgcccgctgtcctgacgtggatgagtgtcgcctgggcctggcccggtgccacccgcgggcgacctgcctgaacacgcccctcagctacgagtgtcactgccagcggggctaccagggtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacaggtctctatggtcactctgctgtctaccacgaggccaccgactccctctacgtgtttggggggttccgattccatgtggagctggcggccccatcccccgagctctactccctgcactgtcctgaccgcacctggagtctgctggccccttctcagggggcaaagcgagatcgtatgaggaatgtgcgtggctcatctcggggtctgggccaagttcctggggagcagcctgggtcatgggggttccgggaagtcaggaagaagatggctctgtgggctgctcttgctggtacaggaggtttcctggaggaaatctcacctcacctgaaggagccccgcccccggcttttccacgcctcagccctgttaggggacaccatggtggttcttggggggcgctcggaccctgacgagttcagcagcgacgttctgctctaccaggtcaactgcaatgcctggcttctgcccgacctcacccgctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggcgtccaccccccgctgtaagtggtgtaccaactgccccgaaggtgcttgcattggacgcaatgggtcctgcacctctgagaatgactgtcggatcaaccagcgagaggtcttctgggcagggaactgctccgaggctgcgtgcggggctgctgactgcgagcagtgcacgcgggagggcaagtgcatgtggacgcggcagttcaagaggacaggggagacccgccgcatcctctccgtgcagcccacctatgactggacgtgcttcagccactctctgctgaatgtgtcccccatgccggtggaatcatcacccccactgccctgccccaccccttgtcacctcctacccaactgtacctcctgcctggactctaagggagcagatgggggctggcagcactgtgtttggagcagcagcctgcagcagtgtctgagcccttcctacctgcccctgcgatgtatggccggaggctgtgggcggctgctccggggacctgagagctgctccctgggctgtgctcaggcaactcagtgcgccttgtgcctgcggcgcccccattgcggctggtgtgcctgggggggccaggatgggggtggccgctgcatggagggtggactcagcggcccccgtgatgggctgacatgtgggcgtccgggggcctcctgggccttcctgtcctgcccccctgaggacgagtgtgcaaacgggcaccacgactgcaacgagacgcagaattgccacgaccagccccacggctatgagtgcagctgcaagaccggctataccatggacaacatgacagggctgtgccgccctgtgtgcgcccagggctgcgtgaacggctcatgtgtggagcccgaccactgccgctgccactttggctttgtgggccgcaactgctccacggaatgccgctgcaaccgccacagtgaatgcgctggtgttggggcgcgtgaccactgcttgctctgccgcaaccacaccaagggcagccactgtgagcagtgcctcccgctgtttgtgggttcagctgtcggaggcgggacctgccggccctgccacgccttttgtcgtggaaatagccacatctgcatctccaggaaggagttacaaatgtccaagggagagccaaagaagtactcactggacccagaggagattgaaaactgggtgacagagggtcctagtgaagacgaggccgtgtgcgtgaactgccagaataacagctatggggagaaatgcgagagctgcctgcagggctacttcctcctggacgggaagtgcaccaaatgccagtgtaatggccacgcggacacatgtaacgagcaggatgggacgggctgtccatgtcagaataacacagagacgggcacatgccagggcagctcccccagtgaccgtcgagactgctacaagtaccagtgcgccaagtgccgggaatcatttcacgggagtccgctgggcggccagcagtgctaccgcctcatctcggtggagcaggagtgctgcctggaccccacgtcccagaccaactgcttccatgagcccaaacgccgggcgctaggccccggccgcactgtcctctttggcgtgcagcccaaattcaccaacgtggacatccgcctgacgctggacgtgaccttcggggccgtggacctctatgtctccacctcctatgacaccttcgtggtccgtgtggcccctgacactggcgtccatactgtacacatccagccacccccagccccaccacctccaccaccccctgcagatggtgggccccggggggctggggatccaggaggagcaggggccagcagtgggccgggcgccccagcagagccacgggtacgggaggtatggccgcggggcctgattacctacgtgacggtgacggagccgtcggcagtgctggtggtccgcggcgtgcgggaccggctggtcatcacctacccacacgagcaccatgccctcaagtcgagccgcttctacctgctgctgctgggcgtgggagacccaagtgggcccggcgccaacggctcagccgactcgcagggcctgctcttcttccggcaggaccaggcccacattgacctgtttgtcttcttctccgtcttcttctcctgcttcttcctcttcctctcactctgtgtgctcctctggaaggccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctcaaaaaaaaaaaaaaaatttaagaggtcactcagttgtgctgtggagaatggaccggagggacaagaggggcagcagggatggtgggctggagtagggtgctggcaatgagggagtctggctcagatgtgggatgtgtatggaagaatataaatgatggtgtggatgtcagggtgagggaggagacaaaaccacgatgacccctagctttgtggcctgaactgtgggtggctgaggggatcgttaattgaatggggcagactgaggcttgtgaggaagatcagagtctggttcttgacatgagatgcccttcagacatctcttcactcaggtccaactagggatacagaaacactgaatatttcaacagcagaaattgaatggggggattgatagcgctggcgagggaagcagctggaaagagacagatggcaccctgagacagcccagaggtgaataggacccccaggctgcagggataaagctcagtggtggtgttacctcaccggggaccagggtcacacagcaaagctggaacaacagaggcgtgttgtgggggagcctcagaggggacaaaacctctgcctgagatcccaccccaggtgggcatgggggccactgaggttggggatgaaaatgccggtaccgtcagtgcacagccctgttccagacagtgctgcctggaagatttctgggctctcctgaggcgccaccccgcacctgagccacctccttggactcctgtcctctaccccttgaggacctccctcccttctaccctagctgtcttcttgaacttgggactctcctttcccaagacttccatcactagctcctggagggactggactttgcatcttcccttcgcgtggagcctcagtgtgagaggccctagccaatgcgtgcatgtcagaggtggtggggaccacatcagaagaagaggggggtgatgaaattaacaaataaaaagtatggggaaaaccca

SEQ ID NO: 18735 - DNA, 2675 bp, Homo sapiens
aactgctccacggaatgccgctgcaaccgccacagtgaatgcgctggtgttggggcgcgtgaccactgcttgctctgccgcaaccacaccaagggcagccactgtgagcagtgcctcccgctgtttgtgggttcagctgtcggaggcgggacctgccggccctgccacgccttttgtcgtggaaatagccacatctgcatctccaggaaggagttacaaatgtccaagggagagccaaagaagtactcactggacccagaggagattgaaaactgggtgacagagggtcctagtgaagacgaggccgtgtgcgtgaactgccagaataacagctatggggagaaatgcgagagctgcctgcagggctacttcctcctggacgggaagtgcaccaatgcgccaagtgccgggaatcatttcacgggagtccgctgggcggccagcagtgctaccgcctcatctcggtggagcaggagtgctgcctggaccccacgtcccagaccaactgcttccatgagcccaaacgccgggcgctaggccccggccgcactgtcctctttggcgtgcagcccaaattcaccaacgtggacatccgcctgacgctggacgtgaccttcggggccgtggacctctatgtctccacctcctatgacaccttcgtggtccgtgtggcccctgacactggcgtccatactgtacacatccagccacccccagccccaccacctccaccaccccctgcagatggtgggccccggggggctggggatccaggaggagcaggggccagcagtgggccgggcgccccagcagagccacgggtacgggaggtatggccgcggggcctgattacctacgtgacggtgacggagccgtcggcagtgctggtggtccgcggcgtgcgggaccggctggtcatcacctacccacacgagcaccatgccctcaagtcgagccgcttctacctgctgctgctgggcgtgggagacccaagtgggcccggcgccaacggctcagccgactcgcagggcctgctcttcttccggcaggaccaggcccacattgacctgtttgtcttcttctccgtcttcttctcctgcttcttcctcttcctctcactctgtgtgctcctctggaaggccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctc

SEQ ID NO: 18736 - DNA, 6298 bp, Homo sapiens
agagggaggtggcgatggtgcgcccggtggcggtggcggcggcggttgcggaggcttccttggtcggattgcaacgaggagaagatgactgaccaaccgactggctgaatgaatgaatggcggagccgagcgcgccatgaggagcctgccgagcctgggcggcctcgccctgttgtgctgcgccgccgccgccgccgccgccgccgtcgcctcagccgcctcggcggggaatgtcaccggtggcggcggggccgcggggcaggtggacgcgtcgccgggccccgggttgcggggcgagcccagccaccccttccctagggcgacggctcccacggcccaggccccgaggaccgggcccccgcgcgccaccgtccaccgacccctggctgcgacttctccagcccagtccccggagaccacccctctttgggcgactgctggaccctcttccaccacctttcaggcgccgctcggcccctcgccgaccacccctccggcggcggaacgcacttcgaccacctctcaggcgccgaccagacccgcgccgaccaccctttcgacgaccactggcccggcgccgaccacccctgtagcgaccaccgtaccggcgcccacgactccccggaccccgacccccgatctccccagcagcagcaacagcagcgtcctccccaccccacctgccaccgaggccccctcttcgcctcctccagagtatgtatgtaactgctctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtagtctcagctacttgggaggctgaggcaggagaatcacttgaacctgggaggcagaggttacagtgagccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttatttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttactgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgtacctattgtagatttgttgtttacttttttgtgtggtcagagttgtttcatgtcttcaaatacatgccaaggatcatttactttcagcccacttcataaaaatctttgaactctt

SEQ ID NO: 18737 - DNA, 6297 bp, Homo sapiens
atgaggagcctgccgagcctgggcggcctcgccctgttgtgctgcgccgccgccgccgccgccgccgccgtcgcctcagccgcctcggcggggaatgtcaccggtggcggcggggccgcggggcaggtggacgcgtcgccgggccccgggttgcggggcgagcccagccaccccttccctagggcgacggctcccacggcccaggccccgaggaccgggcccccgcgcgccaccgtccaccgacccctggctgcgacttctccagcccagtccccggagaccacccctctttgggcgactgctggaccctcttccaccacctttcaggcgccgctcggcccctcgccgaccacccctccggcggcggaacgcacttcgaccacctctcaggcgccgaccagacccgcgccgaccaccctttcgacgaccactggcccggcgccgaccacccctgtagcgaccaccgtaccggcgcccacgactccccggaccccgacccccgatctccccagcagcagcaacagcagcgtcctccccaccccacctgccaccgaggccccctcttcgcctcctccagggcatcagtggcctgtggcaaagatgccccaaaagtatctaggaaaatatgcctgtgagagtaacctgaaaagcaagtacttgcctcttacacagccagtcatgaatcttagagtctcagaagctgttaaaacggagtatgtatgtaactgctctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtagtctcagctacttgggaggctgaggcaggagaatcacttgaacctgggaggcagaggttacagtgagccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttatttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttactgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgtacctattgtagatttgttgtttacttttttgtgtggtcagagttgtttcatgtcttcaaatacatgccaaggatcatttactttcagcccacttcataaaaatctttgaactctt

SEQ ID NO: 18738 - DNA, 2183 bp, Homo sapiens
atctgcagctggctcggcgcactccactgaccgtcccgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgacttta

SEQ ID NO: 18739 - DNA, 2415 bp, Homo sapiens
atctgcagctggctcggcgcactccactgaccgtcccgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgacttta

SEQ ID NO: 18740 - DNA, 2215 bp, Homo sapiens
gcgttttgtgctgctgtcagtagtttttgtccaaagcagaatctttgtaaagtaatacagagttgggaaggttaattgagaaaataaaatactctgtttagactttggcttagagtgaaaaaatagattccatatgttgaattctctctcaccttgtaagtagaaactttgctgatttttagtttgctttctaaagttttccgtgcctgacagaaacagtacttattaatgtatgatgcaatttcattgcgtagcatctctacaacacatttaatcttcaatctctatttctttagccttttctagctattctcatgcgttacagccattataaatggggaataattttaccccaagagtttcctgaccaatatgtgcttatttcagctgtgcggattagtaagatatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttactaccaggacttttctcttccccatgtcaaaatacaatcaataattgatggtaaaagtttggaaattcaagc

SEQ ID NO: 18741 - DNA, 1713 bp, Homo sapiens
atctgcagctggctcggcgcactccactgaccgtcccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatg

SEQ ID NO: 18742 - DNA, 7722 bp, Homo sapiens
ccgcgggattaagtttctcagtcacgcgtgagtgtctgtgcgttttgatccgaagctcctcgccgggtcgttacttcagaagagaagacagtgagcgtgggcgaggcgaggcatccagaggccccggcgacccctgctccccagtcctccgccccctcgcgtcgcggccctgggcgggcgccgcgagccggagttccattttaattgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcattgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgacttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataa

SEQ ID NO: 18743 - DNA, 6361 bp, Homo sapiens
tgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcattgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaa

SEQ ID NO: 18744 - DNA, 7430 bp, Homo sapiens
attttaattgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcattgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgacttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgc

SEQ ID NO: 18745 - DNA, 6001 bp, Homo sapiens
tgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctgggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcattgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaa

SEQ ID NO: 18746 - DNA, 2303 bp, Homo sapiens
aataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcattgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaact

SEQ ID NO: 18747 - DNA, 7603 bp, Homo sapiens
cgtgagtgtctgtgcgttttgatccgaagctcctcgccgggtcgttacttcagaagagaagacagtgagcgtgggcgaggcgaggcatccagaggccccggcgacccctgctccccagtcctccgccccctcgcgtcgcggccctgggcgggcgccgcgagccggagttccattttaattgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcattgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgacttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcac

SEQ ID NO: 18748 - DNA, 6262 bp, Homo sapiens
tgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaagggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcattgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaa

SEQ ID NO: 18749 - DNA, 6176 bp, Homo sapiens
tgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaagggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcattgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaa

SEQ ID NO: 18750 - DNA, 2975 bp, Homo sapiens
cttcgccgcgctcctcatctgccccgcgccgagcgccgccgccgccgccgccgccgccgctccgctgcccgcgccgcccgcggctcccgatggagactgacgcgccccagcccggcctcgcctccccggactcgccgcacgacccctgcaagatgttcatcgggggactcagttggcagactacgcaggaagggctgcgcgaatacttcggccagttcggggaggtgaaggagtgtctggtgatgcgggaccccctgaccaagagatccaggggtttcggcttcgtcactttcatggaccaggcgggggtggataaagtgctggcgcaatcgcggcacgagctcgactccaaaacaattgaccctaaggtggccttccctcggcgagcacagcccaagatggtgactcgaacgaagaagatctttgtgggggggctgtcggtgaacaccacggtggaggacgtgaagcaatattttgagcagtttgggaaggtggacgacgccatgctgatgtttgacaaaaccaccaaccggcaccgagggttcgggtttgtcacgtttgagagtgaggacatcgtggagaaagtgtgtgaaattcattttcatgaaatcaacaacaaaatggtggaatgtaagaaagctcagccaaaggaggtgatgtcgccaacgggctcagcccgggggaggtctcgagtcatgccctacggaatggacgccttcatgctgggcatcggcatgctgggttacccaggtttccaagccacaacctacgccagccggagttatacaggcctcgcccctggctacacctaccagttccccgaattccgtgtagagcggacccctctcccgagcgccccagtcctccccgagcttacagccattcctctcactgcctacggaccaatggcggcggcagcggcggcagcggctgtggttcgagggacaggctctcacccctggacgatggctccccctccaggttcgactcccagccgcacagggggcttcctggggaccaccagccccggccccatggccgagctctacggggcggccaaccaggactcgggggtcagcagttacatcagcgccgccagccctgcccccagcaccggcttcggccacagtcttgggggccctttgattgccacagccttcaccaatgggtaccactgaagcaggggacggtggcaggagcgccccagcctgcagctgactgaggaccacgagtgagccagcgagggggcgggagacctcagccgcagccgccgccccctcccctgcagcgactcggacccgctactgcctgcccccaactccccgggcccggcccctgccctgctgcccccaacagcgtctggctcccctactaacgtccccctcttcgcccttgcccccatccccacccgcccctctcccggccctgcttttatttattttggattagccggttgcccaccccagccctctggtccatccctccctccgtgccgcgcccccctaggaccgccccctccccaaaaggcttttggatttgtgcatagctggagtgaaggcggagggagcctgctacaggccgcagcccaacccctgttttttattcagatttcccctcctttaccctttccctttttttttttttttttttttttaaagaaaccttttttaaactatttctaggtttgtgaatgtgaagccccaggccgcagggggcaaggggccaggtgccccccaccagctgagaacaaagtgtctatctgggtgtgggcccctggccgcctccctccagccctggagaggagggcagggctgcggggaggccaggccgagcccctggaaccatcccgtcctgtatcatatgtaaatactgtgaggtgatgtgcccacccctctctaagacccctcgggggtgaggggctcccccctcccctgtttctgtcccctcagacaccgttactgtaagcttgcaggcctcagctgtggccacggcaggcccgctctctcaggccctcagggtcaaggccttggttggacctgcccactccaaaaacccagtgtgggggcaaagggcgtgggaagagcagggcttgcccagcgacactgctggacaggaattaactctccaaaggtctcccctgctccctacctaggttggggcttcatggtttctgctcagtctgtcccccttccccctcgacccccgcaatgagtgggcaccaggggacgctctggcgagggcagaccccaggggaaagcaaagggcgtctcagggaacccccacattctctcactgaagtttcccaccaggatgaccccacagccagagtcccttggcagcccctcaccccagaccccccttctaaggaaaaagagaggttcagagcgttggaccttcatgaacagtggcctggctggcgtggcagggccaaggcccacccactgccatcccccttctgtgtgtccctctcccccagttatgaggcccagggcctgagctctcttccccagcattgcccccacccggaaaccccacctttggagagttaattgtctgtgtgaggtgcttaacctatcagccctgagaacacaaagcaataatctttgttactgagatgcgcggctgttcgtgttttgggttttttttttttttaatgtttcctaataaaagagaagctgcattttattggtttttatttttaattttctacacgtttgagctgagtcctgagacacttagcttccctctccctcattcccggacccttccaccccactgggcccaaccatgggctcaggaccctggaattccgttttctgatttgctttgggattttttttttttttaagatgttacatggtgtttcgaagccagcaagttaccatcctccggtgtctcttctctccacatctgtaacttctttttccaggttttattttcagttttaaattcctaataaattatttgaaaacgtt

SEQ ID NO: 18751 - DNA, 4538 bp, Homo sapiens
attctcctgcctcagcctcccgagtagatgagatcacaggcacgtgccgccatgccgggttgacttttgtatttttagtagagacggggtttcaccatgttgcctaggctggtcttgaactcctgacctcaggcgattcacccgcctcggcctcccaaagtgttaggattacaggcgtgagccaccgcgcccggcttgaattgtacacttcaaaaggtggaattttatggtgttgaattatatctttatttttttaacggggggaaaatgacgccgctggagaggagttagcggaactgaaacaatgaaatggtgcgcgagtgtcgcctgtccccgtcgcatccatcccaacgaagtttgggccctggaacggtgcacccagaaggcctgcggggagagacgctggggcatgatctggaagaaagacgtctcaggattcgaagggaatgcagctaaggtggcggcggaggttcgcctaggactggggaggcgtccctaggctcagaagttggcccggccggagcggagatttaaaggttggagcgcagaggctcttaaagaggccgagtcgaattcccactcggcgtccaccttaaagccagctccccggcaccacggatctgacccgggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacg

SEQ ID NO: 18752 - DNA, 1803 bp, Homo sapiens
agggtcgaggcacccggcccgggctccccactggcgcgcccgcagcggcgctctatttttagcaggcgctgtggcaatataaggaatgcgcggcgcgctaggcgctcggggcgcacgctggcggcgcggtcgctttaaggaggcgccggggcggggacggaccggagtggccggctggcggggagccgtcagtccggcggccgcggggcccggcgggcgcgacgctgcctcctcaccggcgcaggctaggagggggcggcctgagtgccgtagccgagccggggctggagcgcgcggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctga

SEQ ID NO: 18753 - DNA, 1534 bp, Homo sapiens
aggtgtggccgccctccgggctcggccgcgctctccgcttgcggggtgcgccctgggaccggctgtgcgtggcgttttgcccccatcgcgggctcccgcgtaacggtgtgcgttcgtgaaatcggccacgaccaagaccccagtggggagggcctgcgcgccgctcagagagaccctttcatgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctg

SEQ ID NO: 18754 - DNA, 856 bp, Homo sapiens
gctgtggtcacaactagggcctgggctcatgcattgaactgatctggctgaggcatcagacacggtgccagtcctgccctgcggggaagacaagagcacaaagtgacaagccagtgtggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaac

SEQ ID NO: 18755 - DNA, 271 bp, Homo sapiens
aggtgtggccgccctccgggctcggccgcgctctccgcttgcggggtgcgccctgggaccggctgtgcgtggcgttttgcccccatcgcgggctcccgcgtaacggtgtgcgttcgtgaaatcggccacgaccaagaccccagtggggagggcctgcgcgccgctcagagagaccctttcatggtctgacctacgagaaacatggcaaccagcgccgtccccagtgacaacctccccacatacaagctggtggtggtgggggatgggggtg

SEQ ID NO: 18756 - DNA, 2772 bp, Homo sapiens
gtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagaaatgttgttcatttcttctttcagtaaaccacagaaagataacaaaggctactgcgcccagtacagaggggaggtgtgtaatgcagtcctggcaaaagatgctcttgtttttctcaacacctcctatgcggaccctgaggaggcccaagagctactggtccacacggcctggaatgaactgaaagtagtgagcccagtctgccggccagctgctgaggctttgttgtgtaaccacatcttccaggagtgcagtcctggagtagtgcctactcctattcccatttgcagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagattataacaaagaaaacctaaaaacattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagac

SEQ ID NO: 18757 - DNA, 1221 bp, Homo sapiens
ccctacccattagccccaagatcatagaaaaatcttccaagctggaaactggttgacaatgatcctgactttcagtaggtgtgttttttaaactctgtatacctttttcctctacctgtgttgttatttgaatatgaagttgggagaagacatatcagagattcccaatctaatacgttttaaatttgacgtttttttcccttagactagcattaattgtgtttcacaacaaaacgagatagcatttcatctcacgggacagtacactagatttcatgaggtctcatattatttacagtaaaaagtttctttcataaacgcgcttttttcaagaacaatttaccatgatgatgtcttgaaaacacagaatttaggctctgccacaaatttgctttaacatgtaatgattcatcaagttttgttctccatatactattttagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggtatgaaaatacaagtgaggatatgtatttcatcagaaaacagaggctttccaagtttttctccccttgttcgtgctttttccttttctccttgatcagtgagacgtttcagttccttttcaaatttagcttcttcaccttggtctatcccaaccctataggacattcatggcttaatggattatccctctttaaattcatcacttcaatttgtctctgtctttgctgcctcctatttataaaaatgtttaaaatgtccccat

SEQ ID NO: 18758 - DNA, 435 bp, Homo sapiens
aatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgagggtgctaaaggcattcacacccagtttgtggcttctgccctccagctaagatcgttccttagctgtccccaaatatgagaatgaatatacaatgataaaacaaaaataaatcaa

SEQ ID NO: 18759 - DNA, 839 bp, Homo sapiens
gtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgagggtgctaaaggcattcacacccagtttgtggcttctgccctccagctaagatcgttccttagctgtccccaaatatga

SEQ ID NO: 18760 - DNA, 1696 bp, Homo sapiens
gtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggaagaaagtgaacccgaacaagatactaaagtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagattttagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggtatgaaaatacaagtgaggatatgtatttcatcagaaaacagaggctttccaagtttttctccccttgttcgtgctttttccttttctccttga

SEQ ID NO: 18761 - DNA, 2496 bp, Homo sapiens
gtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggaagaaagtgaacccgaacaagatactaaagtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagattttagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagcattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagac

SEQ ID NO: 18762 - DNA, 2754 bp, Homo sapiens
gtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagaatggagtaaaccacagaaagataacaaaggctactgcgcccagtacagaggggaggtgtgtaatgcagtcctggcaaaagatgctcttgtttttctcaacacctcctatgcggaccctgaggaggcccaagagctactggtccacacggcctggaatgaactgaaagtagtgagcccagtctgccggccagctgctgaggctttgttgtgtaaccacatcttccaggagtgcagtcctggagtagtgcctactcctattcccatttgcagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagattataacaaagaaaacctaaaaacattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagac

SEQ ID NO: 18763 - DNA, 3321 bp, Homo sapiens
gctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagaaatgttgttcatttcttctttcagtaaaccacagaaagataacaaaggctactgcgcccagtacagaggggaggtgtgtaatgcagtcctggcaaaagatgctcttgtttttctcaacacctcctatgcggaccctgaggaggcccaagagctactggtccacacggcctggaatgaactgaaagtagtgagcccagtctgccggccagctgctgaggctttgttgtgtaaccacatcttccaggagtgcagtcctggagtagtgcctactcctattcccatttgcagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagcattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagacgttcaaataaaatgctgcagtttcctctcagactctgtgagccaggggaatcctacaccagaggcccaacaagacccacataggaaagagtaagagtaaacatgagtagtgtgttgtttgcttcccagggagagcaaagacagtgcaaaacccatgtggtagacggacccattgaaagccagtgattggaaacacaggctaggaaatgtgtcagataatggagacaactattcttcttcatgaaggtttgtaatacacactgcacagggaagaatgtcatcctgttcagtttccaaagtagctggtcacagagtaaagctctgctgtattaaattttaatatgaaatgggattcagagcttcattttttaattgagttaattcctgtccattgtgaaagtagcttaatcgtcatgtaagacacttaggtgaagtacagaaaactaaaaagaaggaaaagccactcattctgtctccccccaaagacgagtcttagtgttttattaaatctttcttgcatttaatgcataattttatatttgtttgtattctgcagagttgtggttacattttattgataga

SEQ ID NO: 18764 - DNA, 2754 bp, Homo sapiens
gtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagctttcagtaaaccacagaaagataacaaaggctactgcgcccagtacagaggggaggtgtgtaatgcagtcctggcaaaagatgctcttgtttttctcaacacctcctatgcggaccctgaggaggcccaagagctactggtccacacggcctggaatgaactgaaagtagtgagcccagtctgccggccagctgctgaggctttgttgtgtaaccacatcttccaggagtgcagtcctggagtagtgcctactcctattcccatttgcagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagattataacaaagaaaacctaaaaacattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagac

SEQ ID NO: 18765 - DNA, 2496 bp, Homo sapiens
gtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggaagaaagtgaacccgaacaagatactaaagtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagcctggaaaaagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagcattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagac

SEQ ID NO: 18766 - DNA, 6422 bp, Homo sapiens
ttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 18767 - DNA, 6164 bp, Homo sapiens
ttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 18768 - DNA, 5225 bp, Homo sapiens
gttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgttcccatggtgcacggtgctacgccagccactgtgtccgcagcaacaacatctgccacaagtgttcccttcgctgcaacagccacagccaaccagccccatccttgatgcttctacactgttgggtgcaacatcctgtcctgcagcagcaggaaaaatgatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 18769 - DNA, 5465 bp, Homo sapiens
ccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaa

SEQ ID NO: 18770 - DNA, 5941 bp, Homo sapiens
cttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 18771 - DNA, 5256 bp, Homo sapiens
gttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 18772 - DNA, 5092 bp, Homo sapiens
cgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 18773 - DNA, 1023 bp, Homo sapiens
atggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgttcccatggtgcacggtgctacgccagccactgtgtccgcagcaacaacatctgccacaagtgttcccttcgctgcaacagccacagccaaccagccccatccttgatgcttctacactgttgggtgcaacatcctgtcctgcagcagcaggaaaaatgatacccataatatctgccgaacatctgactagccacaagtatgttacccagatgtag

SEQ ID NO: 18774 - DNA, 4257 bp, Homo sapiens
cgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaac

SEQ ID NO: 18775 - DNA, 1054 bp, Homo sapiens
atggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgatacccataatatctgccgaacatctgactagccacaagtatgttacccagatgtag

SEQ ID NO: 18776 - DNA, 4205 bp, Homo sapiens
gaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagagcagtcactcaggaaatgttgtttaaggggaaccttctggatccttttcatggcaccatggcaagaagaagctgtatcttatctatggaagataaagcatggagttggctaatggatgctgataggaccatctagttgcaggaaaacaagctcagggctcccactgattctacattatgggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaa

SEQ ID NO: 18777 - DNA, 5147 bp, Homo sapiens
gttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 18778 - DNA, 1575 bp, Homo sapiens
aattcatttttaatcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagataccccaattatcaatagatgaactgaatagcagcatgtttgtttcacagatgtagaagttctcagtagaacactgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccattt

SEQ ID NO: 18779 - DNA, 1643 bp, Homo sapiens
tgcccgcactccgagcgtgagccgcagcgcgactttttggcgctctttgggagcagtgagagagaggcggaggccagagagtccggggtgggcgcgggagccggggcggcccttggccgcattcccgcccgtcccgcagcggcgcgcggagccagtggctgactttagaagtctgtagagaatttcagagaggaacttgctctcgagctgatgcagattgcaagtttgcccatccaccaagagtttgccatgtggaaaatggtcgtgtggtggcctgttttgattctctaaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccattt

SEQ ID NO: 18780 - DNA, 1444 bp, Homo sapiens
ggggctgagagtgtcttctactttactctgggcaaatgaaggcctgggagagcctgggctgattccatggagagggcttctaagaatcttaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttc

SEQ ID NO: 18781 - DNA, 2661 bp, Homo sapiens
aattcatttttaatcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaaagtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcataa
